(12) United States Patent
Stephens et al.

(10) Patent No.: US 6,822,071 B1
(45) Date of Patent: Nov. 23, 2004

(54) **POLYPEPTIDES FROM *CHLAMYDIA PNEUMONIAE* AND THEIR USE IN THE DIAGNOSIS, PREVENTION AND TREATMENT OF DISEASE**

(75) Inventors: Richard S. Stephens, Orinda, CA (US); Wayne Mitchell, San Francsico, CA (US); Sue S. Kalman, Saratoga, CA (US); Ronald Davis, Palo Alto, CA (US)

(73) Assignee: The Regents of the University of California, Oakland, CA (US)

( * ) Notice: Subject to any disclaimer, the term of this patent is extended or adjusted under 35 U.S.C. 154(b) by 0 days.

(21) Appl. No.: 09/438,185

(22) Filed: Nov. 11, 1999

(Under 37 CFR 1.47)

Related U.S. Application Data

(60) Provisional application No. 60/128,606, filed on Apr. 8, 1999, and provisional application No. 60/108,279, filed on Nov. 12, 1998.

(51) Int. Cl.$^7$ .......................... A61K 38/00; C07K 14/00
(52) U.S. Cl. ....................... 530/300; 530/350; 530/402; 530/810; 530/811; 530/812; 530/813; 530/814; 530/820; 530/825
(58) Field of Search ................................. 435/183, 184; 514/2; 424/185.1, 190.1, 192.1, 193.1, 234.1, 263.1

(56) References Cited

FOREIGN PATENT DOCUMENTS

WO 99/27105 * 6/1999

OTHER PUBLICATIONS

Gerhold et al—BioEssays 18(12):973–981, 1996.*
Wells et al Journal of Leukocyte Biology 61(5):545–550, 1997.*
Russell et al Journal of Molecular Biology 244:33–350, 1994.*
Rudinger et al, in "Peptide Hormones" Parsons, T.A ets, University Park Press pp. 1–6, 1976.*
Burgess et al, The Journal of Cell Biology, 111:2129–2138, 1990.*
Lazar et al, Molecular and Cellular Biology 8(3):1247–1252, 1988.*
Jobling et al, Mol–Microbiol. 5(7): 1755–67, 1991.*
Pir–68 Database Accession No. E72002 Kalmar et al. Apr. 23, 1999.*

* cited by examiner

*Primary Examiner*—Patricia A. Duffy
(74) *Attorney, Agent, or Firm*—Townsend and Townsend and Crew

(57) ABSTRACT

*Chlamydia pneumoniae* polypeptides are provided. The *C. pneumoniae* polypeptides can be used to prepare pharmaceutical compositions for the treatment or prevention of disease. In addition, the proteins can be used in methods for the diagnosis of *C. pneumoniae* infection.

6 Claims, No Drawings

POLYPEPTIDES FROM *CHLAMYDIA PNEUMONIAE* AND THEIR USE IN THE DIAGNOSIS, PREVENTION AND TREATMENT OF DISEASE

CROSS-REFERENCES TO RELATED APPLICATIONS

The present application is related to No. 60/128,606, filed Apr. 8, 1999 and No. 60/108,279, filed Nov. 12, 1998, which are incorporated herein by reference.

STATEMENT AS TO RIGHTS TO INVENTIONS MADE UNDER FEDERALLY SPONSORED RESEARCH AND DEVELOPMENT

1. Field of the Invention

This invention relates to nucleic acids and polypeptides from *Chlamydia pneumoniae* and to their use in the diagnosis, prevention and treatment of diseases associated with *C. pneumoniae*.

2. Background of the Invention

*Chlamydiaceae* is a family of obligate intracellular parasite with a tropism for epithelial cells lining the mucus membranes. The bacteria have two morphologically distinct forms, "elementary body" and "reticulate body". The elementary body is the infectious form, and has a rigid cell wall, primarily of cross-linked outer membrane proteins. The reticulate body is the intracellular, metabolically active form. A unique developmental cycle between these two forms characterizes *Chlamydia* growth.

*C. pneumoniae* is a human respiratory pathogen that causes acute respiratory disease, and approximately 10% of community-acquired pneumonia Antibody prevalence studies have shown that virtually everyone is infected with *C. pneumoniae* at some time, and that reinfection is common. In addition to respiratory disease, studies have shown an association of this organism with coronary artery disease. It has been demonstrated in atherosclerotic lesions of the aorta and coronary arteries by immunocytochemistry and by polymerase chain reaction (Kuo et al. (1993) *J Infect Dis* 167(4):841–849).

Recent reports have further demonstrated the presence of *C. pneumoniae* in the walls of abdominal aortic aneurysms (Juvonen et al. (1997) *J Vasc Surg* 25(3):499–505). Abdominal aortic aneurysms are frequently associated with atherosclerosis, and inflammation may be an important factor in aneurysmal dilatation. *C. pneumoniae* may play a role in maintaining an inflammation and triggering the development of aortic aneurysms.

Muhlestein et al. (1996) *JACC* 27:1555–61, reported a differential incidence of *Chlamydia* species within the coronary artery wall of patients with atherosclerosis versus those with other forms of cardiovascular disease. The extremely high rate of possible infection in patients with symptomatic atherosclerotic disease compared to the very low rate in patients with normal coronary arteries or coronary artery disease from chronic transplant rejection provides evidence for a direct link between the atherosclerotic process and *Chlamydia* infection. Because a history of chlamydial infection is so prevalent in the population, the issue of causality remains. On a physiologic and pathologic level, abnormal interactions among endothelial cells, platelets, macrophages and lymphocytes may lead to a cascade of events resulting in acute endothelial damage, thrombosis and repair, chronically leading to the development of atheroma in blood vessels.

*C. pneumoniae* is related to other *Chlamydia* species, but the level of sequence similarity is relatively low. Very little is known about the biology of this organism, although it appears to be an important human pathogen. Allelic diversity and structural relationships between specific genes of *Chlamydia* species is described in Kaltenboeck et al. (1993) *J Bacteriol* 175(2):487–502; Gaydos et al. (1992) *Infect Immun* 60(12):5319–5323; Everett et al. (1997) *Int J Syst Bacteriol* 47(2):461–473; and Pudjiatmoko et al. (1997) *Int J Syst Bacteriol* 47(2):425–431.

A number of studies have been published describing methods for detection of *C. pneumoniae*, and for distinguishing between *Chlamydia* species. Such methods include PCR detection (Rasmussen et al. (1992) *Mol Cell Probes* 6(5):389–394; Holland et al. (1990) *J Infect Dis* 162(4): 984–987); a simplified polymerase chain reaction-enzyme immunoassay (Wilson et al. (1996) J Appl Bacteriol 80(4): 431–438); sequence determination and restriction endonuclease cleavage (Herrmann et al. (1996) *J Clin Microbiol* 34(8):1897–1902).

Antigenic and molecular analyses of different *C. pneumoniae* strains is described in Jantos et al. (1997) *Clin Microbiol* 35(3):620–623. Some genes of *C. pneumoniae* have been isolated and sequenced. These include the Gro E operon (Kikuta et al. (1991) Infect Immun 59(12): 4665–4669); the major outer membrane protein Perez et al. (1991) *Infect Immun* 59(6):2195–2199; the DnaK protein homolog (Komak et al. (1991) *Infect Immun* 59(2): 721–725); as well as a number of ribosomal and other genes.

SUMMARY OF THE INVENTION

This invention provides the genomic sequence of *Chlamydia pneumoniae*. The sequence information is useful for a variety of diagnostic and analytical methods. The genomic sequence may be embodied in a variety of media, including computer readable forms, or as a nucleic acid comprising a selected fragment of the sequence. Such fragments generally consist of an open reading frame, transcriptional or translational control elements, or fragments derived therefrom. Proteins encoded by the open reading frames are useful for diagnostic purposes, as well as for their enzymatic or structural activity.

DEFINITIONS

The term "amino acid" refers to naturally occurring and synthetic amino acids, as well as amino acid analogs and amino acid mimetics that function in a manner similar to the naturally occurring amino acids. Naturally occurring amino acids are those encoded by the genetic code, as well as those amino acids that are later modified, e.g., hydroxyproline, γ-carboxyglutamate, and O-phosphoserine. Amino acid analogs refers to compounds that have the same basic chemical structure as a naturally occurring amino acid, i.e., an α carbon that is bound to a hydrogen, a carboxyl group, an amino group, and an R group., e.g., homoserine, norleucine, methionine sulfoxide, methionine methyl sulfonium Such analogs have modified R groups (e.g., norleucine) or modified peptide backbones, but retain the same basic chemical structure as a naturally occurring amino acid. Amino acid mimetics refers to chemical compounds that have a structure that is different from the general chemical structure of an amino acid, but that functions in a manner similar to a naturally occurring amino acid.

Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes.

"Amplification" primers are oligonucleotides comprising either natural or analogue nucleotides that can serve as the basis for the amplification of a select nucleic acid sequence. They include, e.g., polymerase chain reaction primers and ligase chain reaction oligonucleotides.

"Antibody" refers to an immunoglobulin molecule able to bind to a specific epitope on an antigen. Antibodies can be a polyclonal mixture or monoclonal. Antibodies can be intact immunoglobulins derived from natural sources or from recombinant sources and can be immunoreactive portions of intact immunoglobulins. Antibodies may exist in a variety of forms including, for example, Fv, $F_{ab}$, and $F(ab)_2$, as well as in single chains. Single-chain antibodies, in which genes for a heavy chain and a light chain are combined into a single coding sequence, may also be used.

An "antigen" is a molecule that is recognized and bound by an antibody, e.g., peptides, carbohydrates, organic molecules, or more complex molecules such as glycolipids and glycoproteins. The part of the antigen that is the target of antibody binding is an antigenic determinant and a small functional group that corresponds to a single antigenic determinant is called a hapten.

"Biological sample" refers to any sample obtained from a living or dead organism. Examples of biological samples include biological fluids and tissue specimens. Such biological samples can be prepared for analysis of the presence of *C. pneumoniae* nucleic acids, proteins, or antibodies specifically reactive with the proteins.

The term "*C. pneumoniae* gene" shall be intended to mean the open reading frame encoding specific *C. pneumoniae* polypeptides, as well as adjacent 5' and 3' non-coding nucleotide sequences involved in the regulation of expression, up to about 2 kb beyond the coding region, but possibly further in either direction. The gene may be introduced into an appropriate vector for extrachromosomal maintenance or for integration into a host genome.

"Conservatively modified variants" applies to both amino acid and nucleic acid sequences. With respect to particular nucleic acid sequences, conservatively modified variants refers to those nucleic acids which encode identical or essentially identical amino acid sequences, or where the nucleic acid does not encode an amino acid sequence, to essentially identical sequences. Specifically, degenerate codon substitutions may be achieved by generating sequences in which the third position of one or more selected (or all) codons is substituted with mixed-base and/or deoxyinosine residues (Batzer et al., *Nucleic Acids Res.* 19:5081 (1991); Ohtsuka et al., *J. Biol. Chem.* 206:2605–2608 (1985); Rossolini et al., *Mol. Cell. Probes* 8:91–98 (1994)). Because of the degeneracy of the genetic code, a large number of functionally identical nucleic acids encode any given protein. For instance, the codons GCA, GCC, GCG and GCU all encode the amino acid alanine. Thus, at every position where an alanine is specified by a codon, the codon can be altered to any of the corresponding codons described without altering the encoded polypeptide. Such nucleic acid variations are "silent variations," which are one species of conservatively modified variations. Every nucleic acid sequence herein which encodes a polypeptide also describes every possible silent variation of the nucleic acid. One of skill will recognize that each codon in a nucleic acid (except AUG, which is ordinarily the only codon for methionine, and TGG, which is ordinarily the only codon for tryptophan) can be modified to yield a functionally identical molecule. Accordingly, each silen: variation of a nucleic acid which encodes a polypeptide is implicit in each described sequence.

As to amino acid sequences, one of skill will recognize that individual substitutions, deletions or additions to a nucleic acid, peptide, polypeptide, or protein sequence which alters, adds or deletes a single amino acid or a small percentage of amino acids in the encoded sequence is a "conservatively modified variant" where the alteration results in the substitution of an amino acid with a chemically similar amino acid. Conservative substitution tables providing functionally similar amino acids are well known in the art. Such conservatively modified variants are in addition to and do not exclude polymorphic variants, interspecies homologs, and alleles of the invention.

The following groups each contain amino acids that are conservative substitutions for one another:

1) Alanine (A), Glycine (G);
2) Serine (S), Threonine (T);
3) Aspartic acid (D), Glutamic acid (E);
4) Asparagine (N), Glutamine (Q);
5) Cysteine (C), Methionine (M);
6) Arginine (R), Lysine (K), Histidine (H);
7) Isoleucine (I), Leucine (L), Valine (V); and
8) Phenylalanine (F), Tyrosine (Y), Tryptophan (W). see, e.g., Creighton, *Proteins* (1984)).

The terms "identical" or percent "identity," in the context of two or more nucleic acids or polypeptide sequences, refer to two or more sequences or subsequences that are the same or have a specified percentage of amino acid residues or nucleotides that are the same, when compared and aligned for maximum correspondence over a comparison window, as measured using one of the following sequence comparison algorithms or by manual alignment and visual inspection. This definition also refers to the complement of a test sequence, which has a designated percent sequence or subsequence complementarity when the test sequence has a designated or substantial identity to a reference sequence. For example, a designated amino acid percent identity of 95% refers to sequences or subsequences that have at least about 95% amino acid identity when aligned for maximum correspondence over a comparison window as measured using one of the following sequence comparison algorithms or by manual alignment and visual inspection. Such sequences would then be said to have substantial identity, or to be substantially identical to each other. Preferably, sequences have at least about 70% identity, more preferably 80% identity, more preferably 90–95% identity and above. Preferably, the percent identity exists over a region of the sequence that is at least about 25 amino acids in length, more preferably over a region that is 50–100 amino acids in length.

When percentage of sequence identity is used in reference to proteins or peptides, it is recognized that residue positions that are not identical often differ by conservative amino acid substitutions, where amino acids residues are substituted for other amino acid residues with similar chemical properties (e.g., charge or hydrophobicity) and therefore do not change the functional properties of the molecule. Where sequences differ in conservative substitutions, the percent sequence identity may be adjusted upwards to correct for the conservative nature of the substitution. Means for making this adjustment are well known to those of skill in the art.

Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated according to, e.g., the algorithm of Meyers & Miller, *Computer Applic. Biol. Sci.* 4:11–17 (1988) e.g., as implemented in the program PC/GENE (Intelligenetics, Mountain View, Calif., USA).

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identity for the test sequence(s) relative to the reference sequence, based on the designated or default program parameters.

A comparison window includes reference to a segment of any one of the number of contiguous positions selected from the group consisting of from 25 to 600, usually about 50 to about 200, more usually about 100 to about 150 in which a sequence may be compared to a reference sequence of the same number of contiguous positions after the two sequences are optimally aligned. Methods of alignment of sequences for comparison are well-known in the art. Optimal alignment of sequences for comparison can be conducted, e.g., by the local homology algorithm of Smith & Waterman, *Adv. Appl. Math.* 2:482 (1981), by the homology alignment algorithm of Needleman & Wunsch, *J. Mol. Biol.* 48:443 (1970), by the search for similarity method of Pearson & Lipman, *Proc. Nat'l. Acad. Sci. USA* 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Ausubel et al., supra).

One example of a useful algorithm is PILEUP. PILEUP creates a multiple sequence alignment from a group of related sequences using progressive, pairwise alignments to show relationship and percent sequence identity. It also plots a tree or dendogram showing the clustering relationships used to create the alignment. PILEUP uses a simplification of the progressive alignment method of Feng & Doolittle, *J. Mol. Evol.* 35:351–360 (1987). The method used is similar to the method described by Higgins & Sharp, *CABIOS* 5:151–153 (1989). The program can align up to 300 sequences, each of a maximum length of 5,000 nucleotides or amino acids. The multiple alignment procedure begins with the pairwise alignment of the two most similar sequences, producing a cluster of two aligned sequences. This cluster is then aligned to the next most related sequence or cluster of aligned sequences. Two clusters of sequences are aligned by a simple extension of the pairwise alignment of two individual sequences. The final alignment is achieved by a series of progressive, pairwise alignments. The program is run by designating specific sequences and their amino acid or nucleotide coordinates for regions of sequence comparison and by designating the program parameters. Using PILEUP, a reference sequence is compared to other test sequences to determine the percent sequence identity relationship using the following parameters: default gap weight (3.00), default gap length weight (0.10), and weighted end gaps. PILEUP can be obtained from the GCG sequence analysis software package, e.g, version 7.0 (Devereaux et al., *Nuc. Acids Res.* 12:387–395 (1984).

Another example of algorithm that is suitable for determining percent sequence identity (i.e., substantial similarity or identity) is the BLAST algorithm, which is described in Altschul et al., *J. Mol. Biol.* 215:403–410 (1990). Software for performing BLAST analyses is publicly available through the National Center for Biotechnology Information (http://www.ncbi.nlm.nih.gov/). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al, supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always>0) and N (penalty score for mismatching residues, always<0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=4, and a comparison of both strands. For amino acid sequences, the BLASTP program uses as default parameters a wordlength (W) of 3, an expectation (E) of 10, and the BLOSUM62 scoring matrix (see Henikoff & Henikoff, *Proc. Natl. Acad. Sci. USA* 89:10915 (1989)).

The BLAST algorithm also performs a statistical analysis of the similarity between two sequences (see, e.g., Karlin & Altschul, *Proc. Nat'l. Acad. Sci. USA* 90:5873–5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.1, more preferably less than about 0.01, and most preferably less than about 0.001.

An indication that two nucleic acid sequences or polypeptides are substantially identical is that the polypeptide encoded by the first nucleic acid is immunologically cross reactive with the antibodies raised against the polypeptide encoded by the second nucleic acid, as described below. Thus, a polypeptide is typically substantially identical to a second polypeptide, for example, where the two peptides differ only by conservative substitutions. Another indication that two nucleic acid sequences are substantially identical is that the two molecules or their complements hybridize to each other under stringent conditions, as described below.

Another indication that polynucleotide sequences are substantially identical is if two molecules hybridize to each other under stringent conditions. Stringent conditions are sequence dependent and will be different in different circumstances. Generally, stringent conditions are selected to be about 5° C. lower than the thermal melting point (Tm) for the specific sequence at a defined ionic strength and pH. The Tm is the temperature (under defined ionic strength and pH) at which 50% of the target sequence hybridizes to a perfectly matched probe. Typically stringent conditions for a Southern blot protocol involve hybridizing in a buffer comprising 5×SSC, 1% SDS at 65° C. or hybridizing in a buffer containing 5×SSC and 1% SDS at 42° C. and washing at 65° C. with a 0.2×SSC, 0.1% SDS wash.

A "label" is a composition detectable by spectroscopic, photochemical, biochemical, immunochemical, or chemical means. For example, useful labels include $^{32}P$, fluorescent dyes, electron-dense reagents, enzymes (e.g., as commonly used in an ELISA), biotin, dioxigenin, or haptens and proteins for which antisera or monoclonal antibodies are available.

The term "nucleic acid" refers to deoxyribonucleotides or ribonucleotides and polymers thereof in either single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs).

Unless otherwise indicated, a particular nucleic acid sequence also implicitly encompasses conservatively modified variants thereof (e.g., degenerate codon substitutions) and complementary sequences, as well as the sequence explicitly indicated. The term nucleic acid is used interchangeably with gene, cDNA, mRNA oligonucleotide, and polynucleotide.

As used herein a "nucleic acid probe or oligonucleotide" is defined as a nucleic acid capable of binding to a target nucleic acid of complementary sequence through one or more types of chemical bonds, usually through complementary base pairing, usually through hydrogen bond formation. As used herein, a probe may include natural (i.e., A, G, C, or T) or modified bases (7-deazaguanosine, inosine, etc.). In addition, the bases in a probe may be joined by a linkage other than a phosphodiester bond, so long as it does not interfere with hybridization. Thus, for example, probes may be peptide nucleic acids in which the constituent bases are joined by peptide bonds rather than phosphodiester linkages. It will be understood by one of skill in the art that probes may bind target sequences lacking complete complementarity with the probe sequence depending upon the stringency of the hybridization conditions. The probes are preferably directly labeled as with isotopes, chromophores, lumiphores, chromogens, or indirectly labeled such as with biotin to which a streptavidin complex may later bind. By assaying for the presence or absence of the probe, one can detect the presence or absence of the select sequence or subsequence.

A labeled nucleic acid probe or oligonucleotide is one that is bound, either covalently, through a linker, or through ionic, van der Waals or hydrogen bonds to a label such that the presence of the probe may be detected by detecting the presence of the label bound to the probe.

"Pharmaceutically acceptable" means a material that is not biologically or otherwise undesirable, i.e., the material can be administered to an individual along with a Chlamydia antigen without causing any undesirable biological effects or interacting in a deleterious manner with any of the other components of the pharmaceutical composition.

The terms "polypeptide," "peptide" and "protein" are used interchangeably herein to refer to a polymer of amino acid residues. The terms apply to amino acid polymers in which one or more amino acid residue is an analog or mimetic of a corresponding naturally occurring amino acid, as well as to naturally occurring amino acid polymers.

The phrase "specifically or selectively hybridizing to," refers to hybridization between a probe and a target sequence in which the probe binds substantially only to the target sequence, forming a hybridization complex, when the target is in a heterogeneous mixture of polynucleotides and other compounds. Such hybridization is determinative of the presence of the target sequence. Although the probe may bind other unrelated sequences, at least 90%, preferably 95% or more of the hybridization complexes formed are with the target sequence.

The term "recombinant" when used with reference to a cell, or nucleic acid, or vector, indicates that the cell, or nucleic acid, or vector, has been modified by the introduction of a heterologous nucleic acid or the alteration of a native nucleic acid, or that the cell is derived from a cell so modified. Thus, for example, recombinant cells express genes that are not found within the native (non-recombinant) form of the cell or express native genes that are otherwise abnormally expressed, under expressed or not expressed at all.

The phrase "specifically immunoreactive with", when referring to a protein or peptide, refers to a binding reaction between the protein and an antibody which is determinative of the presence of the protein in the presence of a heterogeneous population of proteins and other compounds. Thus, under designated immunoassay conditions, the specified antibodies bind to a particular protein and do not bind in a significant amount to other proteins present in the sample. Specific binding to an antibody under such conditions may require an antibody that is selected for its specificity for a particular protein. A variety of immunoassay formats may be used to select antibodies specifically immunoreactive with a particular protein and are described in detail below.

The phrase "substantially pure" or "isolated" when referring to a Chlamydia peptide or protein, means a chemical composition which is free of other subcellular components of the Chlamydia organism. Typically, a monomeric protein is substantially pure when at least about 85% or more of a sample exhibits a single polypeptide backbone. Minor variants or chemical modifications may typically share the same polypeptide sequence. Depending on the purification procedure, purities of 85%, and preferably over 95% pure are possible. Protein purity or homogeneity may be indicated by a number of means well known in the art, such as polyacrylamide gel electrophoresis of a protein sample, followed by visualizing a single polypeptide band on a polyacrylamide gel upon silver staining. For certain purposes high resolution will be needed and HPLC or a similar means for purification utilized.

DETAILED DESCRIPTION

The present invention provides the nucleotide sequence of the C. pneumoniae genome SEQ ID NO: 1 or a representative fragment thereof, in a form which can be readily used, analyzed, and interpreted by a skilled artisan. As used herein, a "representative fragment" of the nucleotide sequence depicted in SEQ ID NO: 1 refers to any portion which is not presently represented within a publicly available database. Preferred representative fragments of the present invention are open reading frames, expression modulating fragments, uptake modulating fragments, and fragments which can be used to diagnose the presence of *C. pneumoniae* in sample. Using the information provided in the present application, together with routine cloning and sequencing methods, one of ordinary skill in the art will be able to clone and sequence all "representative fragments" of interest including open reading frames (ORFs) encoding a large variety of *C. pneumoniae* proteins. A non-limiting identification of such preferred representative fragments is provided in Table 2 (see Sequence Listing, SEQ ID NOS:2–1074).

Diagnostic use of *C. pneumoniae* Nucleic Acids

Hybridization-based Assays

Using the nucleic acids disclosed here, one of skill can design nucleic acid hybridization-based assays for the detection of *C. pneumoniae*. Any of a number of well known techniques for the specific detection of target nucleic acids can be used. Exemplary hybridization-based assays include, but are not limited to, traditional "direct probe" methods such as Southern Blots, dot blots, in situ hybridization (e.g., FISH), PCR, and the like. The methods can be used in a wide variety of formats including, but not limited to substrate- (e.g. membrane or glass) bound methods or array-based approaches as described below. As noted above, this invention also embraces methods for detecting the presence of *Chlamydia* DNA or RNA in biological samples. These sequences can be used to detect *Chlamydia* in biological samples from patients suspected of being infected. A variety of methods of specific DNA and RNA measurement using nucleic acid hybridization techniques are known to those of skill in the art (see Sambrook et al., supra).

In situ hybridization assays are well known (e.g., Angerer (1987) *Meth. Enzymol* 152: 649). Generally, in situ hybridization comprises the following major steps: (1) fixation of tissue or biological structure to analyzed; (2) prehybridization treatment of the biological structure to increase accessibility of target DNA, and to reduce nonspecific binding; (3) hybridization of the mixture of nucleic acids to the nucleic acid in the biological structure or tissue; (4) post-hybridization washes to remove nucleic acid fragments not bound in the hybridization and (5) detection of the hybridized nucleic acid fragments. The reagent used in each of these steps and the conditions for use vary depending on the particular application.

In a typical in situ hybridization assay, cells are fixed to a solid support, typically a glass slide. If a nucleic acid is to be probed, the cells are typically denatured with heat or alkali. The cells are then contacted with a hybridization solution at a moderate temperature to permit annealing of labeled probes specific to the nucleic acid sequence encoding the protein. The targets (e.g., cells) are then typically washed at a predetermined stringency or at an increasing stringency until an appropriate signal to noise ratio is obtained.

The nucleic acids of this invention are particularly well suited to array-based hybridization formats. Arrays are a multiplicity of different "probe" or "target" nucleic acids (or other compounds) attached to one or more surfaces (e.g., solid, membrane, or gel). In a preferred embodiment, the multiplicity of nucleic acids (or other moieties) is attached to a single contiguous surface or to a multiplicity of surfaces juxtaposed to each other.

In an array format a large number of different hybridization reactions can be run essentially "in parallel." This provides rapid, essentially simultaneous, evaluation of a number of hybridizations in a single "experiment". Methods of performing hybridization reactions in array based formats are well known to those of skill in the art (see, e.g., Pastinen (1997) Genome Res. 7: 606–614; Jackson (1996) *Nature Biotechnology* 14:1685; Chee (1995) *Science* 274: 610; WO 96/17958.

Arrays, particularly nucleic acid arrays can be produced according to a wide variety of methods well known to those of skill in the art. For example, in a simple embodiment, "low density" arrays can simply be produced by spotting (e.g. by hand using a pipette) different nucleic acids at different locations on a solid support (e.g. a glass surface, a membrane, etc.).

This simple spotting, approach has been automated to produce high density spotted arrays (see, e.g., U.S. Pat. No. 5,807,522). This patent describes the use of an automated systems that taps a microcapillary against a surface to deposit a small volume of a biological sample. The process is repeated to generate high density arrays. Arrays can also be produced using oligonucleotide synthesis technology. Thus, for example, U.S. Pat. No. 5,143,854 and PCT patent publication Nos. WO 90/15070 and 92/10092 teach the use of light-directed combinatorial synthesis of high density oligonucleotide arrays.

Many methods for immobilizing nucleic acids on a variety of solid surfaces are known in the art. A wide variety of organic and inorganic polymers, as well as other materials, both natural and synthetic, can be employed as the material for the solid surface. Illustrative solid surfaces include, e.g., nitrocellulose, nylon, glass, quartz, diazotized membranes (paper or nylon), silicones, polyformaldehyde, cellulose, and cellulose acetate. In addition, plastics such as polyethylene, polypropylene, polystyrene, and the like can be used. Other materials which may be employed include paper, ceramics, metals, metalloids, semiconductive materials, cermets or the like. In addition, substances that form gels can be used. Such materials include, e.g., proteins (e.g., gelatins), lipopolysaccharides, silicates, agarose and polyacrylamides. Where the solid surface is porous, various pore sizes may be employed depending upon the nature of the system.

In preparing the surface, a plurality of different materials may be employed, particularly as laminates, to obtain various properties. For example, proteins (e.g., bovine serum albumin) or mixtures of macromolecules (e.g., Denhardt's solution) can be employed to avoid non-specific binding, simplify covalent conjugation, enhance signal detection or the like. If covalent bonding between a compound and the surface is desired, the surface will usually be polyfunctional or be capable of being polyfunctionalized. Functional groups which may be present on the surface and used for linking can include carboxylic acids, aldehydes, amino groups, cyano groups, ethylenic groups, hydroxyl groups, mercapto groups and the like. The manner of linking a wide variety of compounds to various surfaces is well known and is amply illustrated in the literature.

For example, methods for immobilizing nucleic acids by introduction of various functional groups to the molecules is known (see, e.g., Bischoff (1987) *Anal. Biochem.*, 164: 336–344; Kremsky (1987) *Nucl. Acids Res.* 15: 2891–2910). Modified nucleotides can be placed on the target using PCR primers containing the modified nucleotide, or by enzymatic end labeling with modified nucleotides. Use of glass or membrane supports (e.g., nitrocellulose, nylon, polypropylene) for the nucleic acid arrays of the invention is advantageous because of well developed technology employing manual and robotic methods of arraying targets at relatively high element densities. Such membranes are generally available and protocols and equipment for hybridization to membranes is well known.

Target elements of various sizes, ranging from 1 mm diameter down to 1 μm can be used. Smaller target elements containing low amounts of concentrated, fixed probe DNA are used for high complexity comparative hybridizations since the total amount of sample available for binding to each target element will be limited. Thus it is advantageous to have small array target elements that contain a small amount of concentrated probe DNA so that the signal that is obtained is highly localized and bright. Such small array target elements are typically used in arrays with densities greater than $10^4/cm^2$. Relatively simple approaches capable of quantitative fluorescent imaging of 1 $cm^2$ areas have been described that permit acquisition of data from a large number of target elements in a single image (see, e.g., Wittrup (1994) Cytometry 16:206–213).

If fluorescently labeled nucleic acid samples are used, arrays on solid surface substrates with much lower fluorescence than membranes, such as glass, quartz, or small beads, can achieve much better sensitivity. Substrates such as glass or fused silica are advantageous in that they provide a very low fluorescence substrate, and a highly efficient hybridization environment. Covalent attachment of the target nucleic acids to glass or synthetic fused silica can be accomplished according to a number of known techniques (described above). Nucleic acids can be conveniently coupled to glass using commercially available reagents. For instance, materials for preparation of silanized glass with a number of functional groups are commercially available or can be prepared using standard techniques (see, e.g., Gait (1984) Oligonucleotide Synthesis: A Practical Approach, IRL Press, Wash., D.C.). Quartz cover slips, which have at least 10-fold lower autofluorescence than glass, can also be silanized.

Alternatively, probes can also be immobilized on commercially available coated beads or other surfaces. For instance, biotin end-labeled nucleic acids can be bound to commercially available avidin-coated beads. Streptavidin or anti-digoxigenin antibody can also be attached to silanized glass slides by protein-mediated coupling using e.g., protein A following standard protocols (see, e.g., Smith (1992) Science 258: 1122–1126). Biotin or digoxigenin end-labeled nucleic acids can be prepared according to standard techniques. Hybridization to nucleic acids attached to beads is accomplished by suspending them in the hybridization mix, and then depositing them on the glass substrate for analysis after washing. Alternatively, paramagnetic particles, such as ferric oxide particles, with or without avidin coating, can be used.

A variety of other nucleic acid hybridization formats are known to those skilled in the art. For example, common formats include sandwich assays and competition or displacement assays. Hybridization techniques are generally described in Hames and Higgins (1985) *Nucleic Acid Hybridization, A Practical Approach*, IRL Press; Gall and Pardue (1969) *Proc. Natl. Acad. Sci. USA* 63: 378–383; and John et al. (1969) *Nature* 223: 582–587.

Sandwich assays are commercially useful hybridization assays for detecting or isolating nucleic acid sequences. Such assays utilize a "capture" nucleic acid covalently immobilized to a solid support and a labeled "signal" nucleic acid in solution. The sample will provide the target nucleic acid. The "capture" nucleic acid and "signal" nucleic acid probe hybridize with the target nucleic acid to form a "sandwich" hybridization complex. To be most effective, the signal nucleic acid should not hybridize with the capture nucleic acid.

Detection of a hybridization complex may require the binding of a signal generating complex to a duplex of target and probe polynucleotides or nucleic acids. Typically, such binding occurs through ligand and anti-ligand interactions as between a ligand-conjugated probe and an anti-ligand conjugated with a signal.

The sensitivity of the hybridization assays may be enhanced through use of a nucleic acid amplification system that multiplies the target nucleic acid being detected. Examples of such systems include the polymerase chain reaction (PCR) system and the ligase chain reaction (LCR) system. Other methods recently described in the art are the nucleic acid sequence based amplification (NASBAO, Cangene, Mississauga, Ontario) and Q Beta Replicase systems.

Nucleic acid hybridization simply involves providing a denatured probe and target nucleic acid under conditions where the probe and its complementary target can form stable hybrid duplexes through complementary base pairing. The nucleic acids that do not form hybrid duplexes are then washed away leaving the hybridized nucleic acids to be detected, typically through detection of an attached detectable label. It is generally recognized that nucleic acids are denatured by increasing the temperature or decreasing the salt concentration of the buffer containing the nucleic acids, or in the addition of chemical agents, or the raising of the pH. Under low stringency conditions (e.g., low temperature and/or high salt and/or high target concentration) hybrid duplexes (e.g., DNA:DNA, RNA:RNA, or RNA:DNA) will form even where the annealed sequences are not perfectly complementary. Thus specificity of hybridization is reduced at lower stringency. Conversely, at higher stringency (e.g., higher temperature or lower salt) successful hybridization requires fewer mismatches.

One of skill in the art will appreciate that hybridization conditions may be selected to provide any degree of stringency. In a preferred embodiment, hybridization is performed at low stringency to ensure hybridization and then subsequent washes are performed at higher stringency to eliminate mismatched hybrid duplexes. Successive washes may be performed at increasingly higher stringency (e.g., down to as low as 0.25×SSPE-T at 37° C. to 70° C.) until a desired level of hybridization specificity is obtained. Stringency can also be increased by addition of agents such as formamide. Hybridization specificity may be evaluated by comparison of hybridization to the test probes with hybridization to the various controls that can be present.

In general, there is a tradeoff between hybridization specificity (stringency) and signal intensity. Thus, in a preferred embodiment, the wash is performed at the highest stringency that produces consistent results and that provides a signal intensity greater than approximately 10% of the background intensity. Thus, in a preferred embodiment, the hybridized array may be washed at successively higher stringency solutions and read between each wash. Analysis of the data sets thus produced will reveal a wash stringency above which the hybridization pattern is not appreciably altered and which provides adequate signal for the particular probes of interest.

Methods of optimizing hybridization conditions are well known to those of skill in the art (see, eg., Tijssen (1993) *Laboratory Techniques in Biochemistry and Molecular Biology, Vol.* 24: *Hybridization With Nucleic Acid Probes*, Elsevier, N.Y.).

Labeling and Detection of Nucleic Acids

In a preferred embodiment, the hybridized nucleic acids are detected by detecting one or more labels attached to the sample or probe nucleic acids. The labels may be incorporated by any of a number of means well known to those of skill in the art. Means of attaching labels to nucleic acids include, for example nick translation to end-labeling (e.g. with a labeled RNA) by kinasing of the nucleic acid and subsequent attachment (ligation) of a nucleic acid linker joining the sample nucleic acid to a label (e.g., a fluorophore). A wide variety of linkers for the attachment of labels to nucleic acids are also known. In addition, intercalating dyes and fluorescent nucleotides can also be used.

Detectable labels suitable for use in the present invention include any composition detectable by spectroscopic, photochemical, biochemical, immunochemical, electrical, optical or chemical means. Useful labels in the present invention include biotin for staining with labeled streptavidin conjugate, magnetic beads (e.g., Dynabeads™), fluorescent dyes (e.g., fluorescein, texas red, rhodamine, green fluorescent protein, and the like, see, e.g., Molecular Probes, Eugene, Oreg., USA), radiolabels (e.g., $^3$H, $^{125}$I, $^{35}$S, $^{14}$C, or $^{32}$P), enzymes (e.g., horse radish peroxidase, alkaline phosphatase and others commonly used in an ELISA), and colorimetric labels such as colloidal gold (e.g., gold particles in the 40–80 nm diameter size range scatter green light with high efficiency) or colored glass or plastic (e.g., polystyrene, polypropylene, latex, etc.) beads. Patents teaching the use of such labels include U.S. Pat. Nos. 3,817,837; 3,850,752; 3,939,350; 3,996,345; 4,277,437; 4,275,149; and 4,366,241.

A fluorescent label is preferred because it provides a very strong signal with low background. It is also optically detectable at high resolution and sensitivity through a quick scanning procedure. The nucleic acid samples can all be labeled with a single label, e.g., a single fluorescent label. Alternatively, in another embodiment, different nucleic acid samples can be simultaneously hybridized where each nucleic acid sample has a different label. For instance, one target could have a green fluorescent label and a second target could have a red fluorescent label. The scanning step will distinguish cites of binding of the red label from those binding the green fluorescent label. Each nucleic acid sample (target nucleic acid) can be analyzed independently from one another.

Suitable chromogens which can be employed include those molecules and compounds which absorb light in a distinctive range of wavelengths so that a color can be observed or, alternatively, which emit light when irradiated with radiation of a particular wave length or wave length range, e.g., fluorescers.

Desirably, fluorescers should absorb light above about 300 nm, preferably about 350 nm, and more preferably above about 400 nm, usually emitting at wavelengths greater than about 10 nm higher than the wavelength of the light absorbed. It should be noted that the absorption and emission characteristics of the bound dye can differ from the unbound dye. Therefore, when referring to the various wavelength ranges and characteristics of the dyes, it is intended to indicate the dyes as employed and not the dye which is unconjugated and characterized in an arbitrary solvent.

Fluorescers are generally preferred because by irradiating a fluorescer with light, one can obtain a plurality of emissions. Thus, a single label can provide for a plurality of measurable events.

Detectable signal can also be provided by chemiluminescent and bioluminescent sources. Chemiluminescent sources include a compound which becomes electronically excited by a chemical reaction and can then emit light which serves as the detectable signal or donates energy to a fluorescent acceptor. Alternatively, luciferins can be used in conjunction with luciferase or lucigenins to provide bioluminescence. Spin labels are provided by reporter molecules with an unpaired electron spin which can be detected by electron spin resonance (ESR) spectroscopy. Exemplary spin labels include organic free radicals, transitional metal complexes, particularly vanadium, copper, iron, and manganese, and the like. Exemplary spin labels include nitroxide free radicals.

The label may be added to the target (sample) nucleic acid(s) prior to, or after the hybridization. So called "direct labels" are detectable labels that are directly attached to or incorporated into the target (sample) nucleic acid prior to hybridization. In contrast, so called "indirect labels" are joined to the hybrid duplex after hybridization. Often, the indirect label is attached to a binding moiety that has been attached to the target nucleic acid prior to the hybridization. Thus, for example, the target nucleic acid may be biotinylated before the hybridization. After hybridization, an avidin-conjugated fluorophore will bind the biotin bearing hybrid duplexes providing a label that is easily detected. For a detailed review of methods of labeling nucleic acids and detecting labeled hybridized nucleic acids see *Laboratory Techniques in Biochemistry and Molecular Biology; Vol.* 24: *Hybridization With Nucleic Acid Probes,* P. Tijssen, ed. Elsevier, N.Y., (1993)).

Fluorescent labels are easily added during an in vitro transcription reaction. Thus, for example, fluorescein labeled UTP and CTP can be incorporated into the RNA produced in an in vitro transcription.

The labels can be attached directly or through a linker moiety. In general, the site of label or linker-label attachment is not limited to any specific position. For example, a label may be attached to a nucleoside, nucleotide, or analogue thereof at any position that does not interfere with detection or hybridization as desired. For example, certain Label-ON Reagents from Clontech (Palo Alto, Calif.) provide for labeling interspersed throughout the phosphate backbone of an oligonucleotide and for terminal labeling at the 3' and 5' ends. As shown for example herein, labels can be attached at positions on the ribose ring or the ribose can be modified and even eliminated as desired. The base moieties of useful labeling reagents can include those that are naturally occurring or modified in a manner that does not interfere with the purpose to which they are put. Modified bases include but are not limited to 7-deaza A and G, 7-deaza-8-aza A and G, and other heterocyclic moieties.

It will be recognized that fluorescent labels are not to be limited to single species organic molecules, but include inorganic molecules, multi-molecular mixtures of organic and/or inorganic molecules, crystals, heteropolymers, and the like. Thus, for example, CdSe-CdS core-shell nanocrystals enclosed in a silica shell can be easily derivatized for coupling to a biological molecule (Bruchez et al (1998) *Science,* 281: 2013–2016). Similarly, highly fluorescent quantum dots (zinc sulfide-capped cadmium selenide) have been covalently coupled to biomolecules for use in ultrasensitive biological detection (Warren and Nie (1998) *Science,* 281: 2016–2018).

Amplification-based Assays

In another embodiment, amplification-based assays can be used to detect nucleic acids. In such amplification-based assays, the nucleic acid sequences act as a template in an amplification reaction (e.g. Polymerase Chain Reaction (PCR). Detailed protocols for quantitative PCR are provided in Innis et al. (1990) *PCR Protocols, A Guide to Methods and Applications,* Academic Press, Inc. N.Y.).

Other suitable amplification methods include, but are not limited to ligase chain reaction (LCR) (see Wu and Wallace (1989) *Genomics* 4: 560, Landegren et al. (1988) *Science* 241: 1077, and Barringer et al. (1990) *Gene* 89: 117, transcription amplification (Kwoh et al (1989) *Proc. Natl. Acad. Sci. USA* 86: 1173), and self-sustained sequence replication (Guatelli et al. (1990) *Proc. Nat. Acad. Sci. USA* 87: 1874).

Detection of *C. pneumoniae* Gene Expression

The nucleic acids of the invention can also be used to *C. pneumoniae* detect gene transcripts. Methods of detecting and/or quantifying gene transcripts using nucleic acid hybridization techniques are known to those of skill in the art (see Sambrook et al. supra). For example, a Northern transfer may be used for the detection of the desired mRNA directly. In brief, the mRNA is isolated from a given cell sample using, for example, an acid guanidinium-phenol-chloroform extraction method. The mRNA is then electrophoresed to separate the mRNA species and the mRNA is transferred from the gel to a nitrocellulose membrane. As with the Southern blots, labeled probes are used to identify and/or quantify the target mRNA.

In another preferred embodiment, the gene transcript can be measured using amplification (e.g. PCR) based methods as described above for directly assessing copy number of the target sequences.

Expression of *C. pneumoniae* Proteins

The nucleic acids disclosed here can be used for recombinant expression of the proteins. In these methods, the nucleic acids encoding the proteins of interest are introduced into suitable host cells, followed by induction of the cells to produce large amounts of the protein. The invention relies on routine techniques in the field of disclosing the general methods of use in this invention is Sambrook et al., *Molecular Cloning, A Laboratory Manual* (2nd ed. 1989).

Standard transfection methods are used to produce prokaryotic, mammalian, yeast or insect cell lines which express large quantities of the desired polypeptide, which is then purified using standard techniques (see. e.g., Colley et al., *J. Biol. Chem.* 264:17619–17622, 1989; *Guide to Protein Purification,* supra).

The nucleotide sequences used to transfect the host cells can be modified to yield *Chlamydia* polypeptides with a variety of desired properties. For example, the polypeptides can vary from the naturally-occurring sequence at the primary structure level by amino acid, insertions, substitutions, deletions, and the like. These modifications can be used in a number of combinations to produce the final modified protein chain.

The amino acid sequence variants can be prepared with various objectives in mind, including facilitating purification and preparation of the recombinant polypeptide. The modified polypeptides are also useful for modifying plasma half life, improving therapeutic efficacy, and lessening the severity or occurrence of side effects during therapeutic use. The amino acid sequence variants are usually predetermined variants not found in nature but exhibit the same immunogenic activity as naturally occurring protein. In general, modifications of the sequences encoding the polypeptides may be readily accomplished by a variety of well-known techniques, such as site-directed mutagenesis (see Gillman & Smith, *Gene* 8:81–97 (1979); Roberts et al., *Nature* 328:731–734 (1987)). One of ordinary skill will appreciate that the effect of many mutations is difficult to predict. Thus, most modifications are evaluated by routine screening in a suitable assay for the desired characteristic. For instance, the effect of various modifications on the ability of the polypeptide to elicit a protective immune response can be easily determined using in vitro assays. For instance, the polypeptides can be tested for their ability to induce lymphoproliferation, T cell cytotoxicity, or cytokine production using standard techniques.

The particular procedure used to introduce the genetic material into the host cell for expression of the polypeptide is not particularly critical. Any of the well known procedures for introducing foreign nucleotide sequences into host cells may be used. These include the use of calcium phosphate transfection, spheroplasts, electroporation, liposomes, microinjection, plasmid vectors, viral vectors and any of the other well known methods for introducing cloned genomic DNA, cDNA, synthetic DNA or other foreign genetic material into a host cell (see Sambrook et al., supra). It is only necessary that the particular procedure utilized be capable of successfully introducing at least one gene into the host cell which is capable of expressing the gene.

Any of a number of well known cells and cell lines can be used to express the polypeptides of the invention. For instance, prokaryotic cells such as *E. coli* can be used. Eukaryotic cells include, yeast, Chinese hamster ovary (CHO) cells, COS cells, and insect cells.

The particular vector used to transport the genetic information into the cell is also not particularly critical. Any of the conventional vectors used for expression of recombinant proteins in prokaryotic and eukaryotic cells may be used. Expression vectors for mammalian cells typically contain regulatory elements from eukaryotic viruses.

The expression vector typically contains a transcription unit or expression cassette that contains all the elements required for the expression of the polypeptide DNA in the host cells. A typical expression cassette contains a promoter operably linked to the DNA sequence encoding a polypeptide and signals required for efficient polyadenylation of the transcript. The term “operably linked” as used herein refers to linkage of a promoter upstream from a DNA sequence such that the promoter mediates transcription of the DNA sequence. The promoter is preferably positioned about the same distance from the heterologous transcription start site as it is from the transcription start site in its natural setting. As is known in the art, however, some variation in this distance can be accommodated without loss of promoter function.

Following the growth of the recombinant cells and expression of the polypeptide, the culture medium is harvested for purification of the secreted protein. The media are typically clarified by centrifugation or filtration to remove cells and cell debris and the proteins are concentrated by adsorption to any suitable resin or by use of ammonium sulfate fractionation, polyethylene glycol precipitation, or by ultrafiltration. Other routine means known in the art may be equally suitable. Further purification of the polypeptide can be accomplished by standard techniques, for example, affinity chromatography, ion exchange chromatography, sizing chromatography, $His_6$ tagging and Ni-agarose chromatography (as described in Dobeli et al., *Mol. and Biochem. Parasit.* 41:259–268 (1990)), or other protein purification techniques to obtain homogeneity. The purified proteins are then used to produce pharmaceutical compositions, as described below.

An alternative method of preparing recombinant polypeptides useful as vaccines involves the use of recombinant viruses (e.g., vaccinia). Vaccinia virus is grown in suitable cultured mammalian cells such as the HeLa S3 spinner cells, as described by Mackett et al., in *DNA cloning Vol. II: A practical approach,* pp. 191–211 (Glover, ed.).

Antibody Production

The proteins of the present invention can be used to produce antibodies specifically reactive with *C pneumoniae* antigens. If isolated proteins are used, they may be recombinantly produced or isolated from *Chlamydia* cultures. Synthetic peptides made using the protein sequences may also be used.

Methods of production of polyclonal antibodies are known to those of skill in the art. In brief, an immunogen, preferably a purified protein, is mixed with an adjuvant and animals are immunized. When appropriately high titers of antibody to the immunogen are obtained, blood is collected from the animal and antisera is prepared. Further fractionation of the antisera to enrich for antibodies reactive to *Chlamydia* proteins can be done if desired (see Harlow & Lane, *Antibodies: A Laboratory Manual* (1988)).

Polyclonal antisera are used to identify and characterize *Chlamydia* in the tissues of patients using, for instance, in situ techniques and immunoperoxidase test procedures described in Anderson et al. *JAVMA* 198:241 (1991) and Barr et al. *Vet. Pathol.* 28:110–116 (1991).

Monoclonal antibodies may be obtained by various techniques familiar to those skilled in the art. Briefly, spleen cells from an animal immunized with a desired antigen are immortalized, commonly by fusion with a myeloma cell (see Kohler & Milstein, *Eur. J. Immunol.* 6:511–519(1976)). Alternative methods of immortalization include transformation with Epstein Barr Virus, oncogenes, or retroviruses, or other methods well known in the art. Colonies arising from single immortalized cells are screened for production of antibodies of the desired specificity and affinity for the antigen, and yield of the monoclonal antibodies produced by such cells may be enhanced by various techniques, including injection into the peritoneal cavity of a vertebrate host.

Monoclonal antibodies produced in such a manner are used, for instance, in ELISA diagnostic tests, immunoperoxidase tests, immunohistochemical tests, for the in vitro evaluation of spirochete invasion, to select candidate antigens for vaccine development, protein isolation, and for screening genomic and cDNA libraries to select appropriate gene sequences.

Immunodiagonostic Detection of *C. pneumoniae* Infections

The present invention also provides methods for detecting the presence or absence of *C. pneumoniae,* or antibodies reactive with it, in a biological sample. For instance, antibodies specifically reactive with *Chlamydia* can be detected using either *Chlamydia* proteins or the isolates described here. The proteins and isolates can also be used to raise specific antibodies (either monoclonal or polyclonal) to detect the antigen in a sample. In addition, the nucleic acids disclosed and claimed here can be used to detect *Chlamydia*-specific sequences using standard hybridization techniques.

For a review of immunological and immunoassay procedures in general, see *Basic and Clinical Immunology* (Stites & Terr ed., 7th ed. 1991)). The immunoassays of the present invention can be performed in any of several configurations, which are reviewed extensively in *Enzyme Immunoassay* (Maggio, ed., 1980); Tijssen, *Laboratory Techniques in Biochemistry and Molecular Biology* (1985)). For instance, the proteins and antibodies disclosed here are conveniently used in ELISA, immunoblot analysis and agglutination assays.

In brief, immunoassays to measure anti-*Chlamydia* antibodies or antigens can be either competitive or noncompetitive binding assays. In competitive binding assays, the sample analyte (e.g., anti-*Chlamydia* antibodies) competes with a labeled analyte (e.g., anti-*Chlamydia* monoclonal antibody) for specific binding sites on a capture agent (e.g., isolated *Chlamydia* protein) bound to a solid surface. The concentration of labeled analyte bound to the capture agent is inversely proportional to the amount of free analyte present in the sample.

Noncompetitive assays are typically sandwich assays, in which the sample analyte is bound between two analyte-specific binding reagents. One of the binding agents is used as a capture agent and is bound to a solid surface. The second binding agent is labelled and is used to measure or detect the resultant complex by visual or instrument means.

A number of combinations of capture agent and labelled binding agent can be used. For instance, an isolated *Chlamydia* protein or culture can be used as the capture agent and labelled anti-human antibodies specific for the constant region of human antibodies can be used as the labelled binding agent. Goat, sheep and other non-human antibodies specific for human immunoglobulin constant regions (e.g., $\gamma$ or $\mu$) are well known in the art. Alternatively, the anti-human antibodies can be the capture agent and the antigen can be labelled.

Various components of the assay, including the antigen, anti-*Chlamydia* antibody, or anti-human antibody, may be bound to a solid surface. Many methods for immobilizing biomolecules to a variety of solid surfaces are known in the art. For instance, the solid surface may be a membrane (e.g., nitrocellulose), a microtiter dish (e.g., PVC or polystyrene) or a bead. The desired component may be covalently bound or noncovalently attached through nonspecific bonding.

Alternatively, the immunoassay may be carried out in liquid phase and a variety of separation methods may be employed to separate the bound labeled component from the unbound labelled components. These methods are known to those of skill in the art and include immunoprecipitation, column chromatography, adsorption, addition of magnetizable particles coated with a binding agent and other similar procedures.

An immunoassay may also be carried out in liquid phase without a separation procedure. Various homogeneous immunoassay methods are now being applied to immunoassays for protein analytes. In these methods, the binding of the binding agent to the analyte causes a change in the signal emitted by the label, so that binding may be measured without separating the bound from the unbound labelled component.

Western blot (immunoblot) analysis can also be used to detect the presence of antibodies to *Chlamydia* in the sample. This technique is a reliable method for confirming the presence of antibodies against a particular protein in the sample. The technique generally comprises separating proteins by gel electrophoresis on the basis of molecular weight, transferring the separated proteins to a suitable solid support, (such as a nitrocellulose filter, a nylon filter, or derivatized nylon filter), and incubating the sample with the separated proteins. This causes specific target antibodies present in the sample to bind their respective proteins. Target antibodies are then detected using labeled anti-human antibodies.

The immunoassay formats described above employ labelled assay components. The label may be coupled directly or indirectly to the desired component of the assay according to methods well known in the art. A wide variety of labels may be used. The component may be labelled by any one of several methods. Traditionally a radioactive label incorporating $^3H$, $^{125}I$, $^{35}S$, $^{14}C$, or $^{32}P$ was used. Non-radioactive labels include ligands which bind to labelled antibodies, fluorophores, chemiluminescent agents, enzymes, and antibodies which can serve as specific binding pair members for a labelled ligand. The choice of label depends on sensitivity required, ease of conjugation with the compound, stability requirements, and available instrumentation.

Enzymes of interest as labels will primarily be hydrolases, particularly phosphatases, esterases and glycosidases, or oxidoreductases, particularly peroxidases. Fluorescent compounds include fluorescein and its derivatives, rhodamine and its derivatives, dansyl, umbelliferone, etc. Chemiluminescent compounds include luciferin, and 2,3-dihydrophthalazinediones, e.g., luminol. For a review of various labelling or signal producing systems which may be used, see U.S. Pat. No. 4,391,904, which is incorporated herein by reference.

Non-radioactive labels are often attached by indirect means. Generally, a ligand molecule (e.g., biotin) is covalently bound to the molecule. The ligand then binds to an anti-ligand (e.g., streptavidin) molecule which is either inherently detectable or covalently bound to a signal system, such as a detectable enzyme, a fluorescent compound, or a chemiluminescent compound. A number of ligands and anti-ligands can be used. Where a ligand has a natural anti-ligand, for example, biotin, thyroxine, and cortisol, it can be used in conjunction with the labelled, naturally occurring anti-ligands. Alternatively, any haptenic or antigenic compound can be used in combination with an antibody.

Some assay formats do not require the use of labelled components. For instance, agglutination assays can be used to detect the presence of the target antibodies. In this case, antigen-coated particles are agglutinated by samples comprising the target antibodies. In this format, none of the components need be labelled and the presence of the target antibody is detected by simple visual inspection.

Pharmaceutical Compositions

The peptides or antibodies (typically monoclonal antibodies) of the present invention and pharmaceutical compositions thereof are useful for administration to mammals, particularly humans, to treat and/or prevent *Chlamydia* infections. Suitable formulations are found in *Remington's Pharmaceutical Sciences,* Mack Publishing Company, Philadelphia, Pa., 17th ed. (1985).

The immunogenic peptides or antibodies of the invention are administered prophylactically or to an individual already suffering from the disease. The peptide compositions are administered to a patient in an amount sufficient to elicit an effective immune response to *Chlamydia*. An effective immune response is one that inhibits infection. An amount adequate to accomplish this is defined as "therapeutically effective dose" or "immunogenically effective dose." Amounts effective for this use will depend on, e.g., the peptide composition, the manner of administration, the stage and severity of the disease being treated, the weight and general state of health of the patient, and the judgment of the prescribing physician, but generally range for the initial immunization (that is for therapeutic or prophylactic administration) from about 0.1 mg to about 1.0 mg per 70 kilogram patient, more commonly from about 0.5 mg to about 0.75 mg per 70 kg of body weight. Boosting dosages are typically from about 0.1 mg to about 0.5 mg of peptide using a boosting regimen over weeks to months depending upon the patient's response and condition. A suitable protocol would include injection at time 0, 4, 2, 6, 10 and 14 weeks, followed by further booster injections at 24 and 28 weeks.

For therapeutic use, administration should begin at the first sign of infection. This is followed by boosting doses until at least symptoms are substantially abated and for a period thereafter. In some circumstances, loading doses followed by boosting doses may be required. The resulting immune response helps to cure or at least partially arrest symptoms and/or complications. Vaccine compositions containing the peptides are administered prophylactically to a patient susceptible to or otherwise at risk of the infection.

The pharmaceutical compositions (containing either peptides or antibodies) are intended for parenteral or oral administration. Preferably, the pharmaceutical compositions are administered parenterally, e.g., subcutaneously, intradermally, or intramuscularly. Thus, the invention provides compositions for parenteral administration which comprise a solution of the immunogenic polypeptides dissolved or suspended in an acceptable carrier, preferably an aqueous carrier. A variety of aqueous carriers may be used, e.g., water, buffered water, 0.4% saline, 0.3% glycine, hyaluronic acid and the like. These compositions may be sterilized by conventional, well known sterilization techniques, or may be sterile filtered. The resulting aqueous solutions may be packaged for use as is, or lyophilized, the lyophilized preparation being combined with a sterile solution prior to administration. The compositions may contain pharmaceutically acceptable auxiliary substances as required to approximate physiological conditions, such as buffering agents, tonicity adjusting agents, wetting agents and the like, for example, sodium acetate, sodium lactate, sodium chloride, potassium chloride, calcium chloride, sorbitan monolaurate, triethanolamine oleate, etc.

The compositions may also comprise carriers to enhance the immune response. Useful carriers are well known in the art, and include, e.g., KLH, thyroglobulin, albumins such as human serum albumin, tetanus toxoid, polyamino acids such as poly(lysine:glutamic acid), influenza, hepatitis B virus core protein, hepatitis B virus recombinant vaccine and the like.

For solid compositions, conventional nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10–95% of active ingredient, that is, one or more peptides of the invention, and more preferably at a concentration of 25%–75%.

As noted above, the peptide compositions are intended to induce an immune response to *Chlamydia*. Thus, compositions and methods of administration suitable for maximizing the immune response are preferred. For instance, peptides may be introduced into a host, including humans, linked to a carrier or as a homopolymer or heteropolymer of active peptide units from various *Chlamydia* proteins disclosed here. Alternatively, a "cocktail" of polypeptides can be used. A mixture of more than one polypeptide has the advantage of increased immunological reaction and, where different peptides are used to make up the polymer, the additional ability to induce antibodies to a number of epitopes.

The compositions also include an adjuvant. As used here, number of adjuvants are well known to one skilled in the art. Suitable adjuvants include incomplete Freund's adjuvant, alum, aluminum phosphate, aluminum hydroxide, N-acetyl-muramyl-L-threonyl-D-isoglutamine (thr-MDP), N-acetyl-nor-muramyl-L-alanyl-D-isoglutamine (CGP 11637, referred to as nor-MDP), N-acetylmuramyl-Lalanyl-D-isoglutaminyl-L-alanine-2-(1'-2'-dipalmitoyl-sn-glycero-3-hydroxyphosphoryloxy)-ethylamine (CGP 19835A, referred to as MTP-PE), and RIBI, which contains three components extracted from bacteria, monophosphoryl lipid A, trehalose dimycolate and cell wall skeleton (MPL+TDM+CWS) in a 2% squalene/Tween 80 emulsion. The effectiveness of an adjuvant may be determined by measuring the amount of antibodies directed against the immunogenic peptide.

The concentration of immunogenic peptides of the invention in the pharmaceutical formulations can vary widely, i.e. from less than about 0.1%, usually at or at least about 2% to as much as 20% to 50% or more by weight, and will be selected primarily by fluid volumes, viscosities, etc., in accordance with the particular mode of administration selected.

The peptides of the invention can also be expressed by attenuated viral hosts, such as vaccinia or fowlpox. This approach involves the use of vaccinia virus as a vector to express nucleotide sequences that encode the peptides of the invention. Upon introduction into a host, the recombinant vaccinia virus expresses the immunogenic peptide, and thereby elicits an immune response. Vaccinia vectors and methods useful in immunization protocols are described in, e.g., U.S. Pat. No. 4,722,848. Another vector is BCG (Bacille Calmette Guerin). BCG vectors are described in Stover et al. (*Nature* 351:456–460 (1991)). A wide variety of other vectors useful for therapeutic administration or immunization of the peptides of the invention, e.g., *Salmonella typhi* vectors and the like, will be apparent to those skilled in the art from the description herein.

The DNA encoding one or more of the peptides of the invention can also be administered to the patient. This approach is described, for instance, in Wolff et, al., *Science* 247: 1465–1468 (1990) as well as U.S. Pat. Nos. 5,580,859 and 5,589,466.

In order to enhance serum half-life, the peptides may also be encapsulated, introduced into the lumen of liposomes, prepared as a colloid, or other conventional techniques may be employed which provide an extended serum half-life of the peptides. A variety of methods are available for preparing liposomes, as described in, e.g., Szoka et al., *Ann. Rev. Biophys. Bioeng.* 9:467 (1980), U.S. Pat. Nos. 4, 235,871, 4,501,728 and 4,837,028.

EXAMPLES

The following examples are offered to illustrate, but no to limit the claimed invention.

Example 1

This example describes comparison of the *C. pneumoniae* genome disclosed here and the, previously sequenced, *C. trachomatis* genome (Stephens, et al. *Science* 282:754–759 (1998)).

The apparent low level of DNA homology between *C. trachomatis* and *C. pneumoniae* (Campbell, et al., *J. Clin. Microbiol.* 25:1911–1916 (1987)) yet analogous cell structures and developmental cycles, predicts that comparative analysis of the two genomes will significantly enhance the understanding of both pathogens. Identification of genes that are present in one species but not the other are of particular importance for the mutually exclusive biological, virulence and pathogenesis capabilities of each. Identification of genes shared between the two species strongly supports the requirement for these capabilities in a biological system that has, over its long-term association with mammalian host cells, evolved to reduce the metabolic capacities while optimizing survival, growth and transmission of these unique pathogens.

The previously sequenced *C. trachomatis* genome contains 1,042,519 nucleotides and 875 likely protein-coding genes. Similarity searching permitted the inferred functional assignment of sequences 636 (60%) genes disclosedlhere and 251 (23%) are similar to hypothetical genes for other bacterial organisms including those for *C. trachomatis*. The remaining 186 (17%) genes are not homologous to sequences deposited in GenBank., Seventy *C. trachomatis* genes are not represented in the *C. pneumoniae* genome. These are contained within blocks consisting of 2–17 genes and 19 single genes. Of the 70 *C. trachomatis* genes without homologs in *C. pneumoniae*, 60 are classified as encoding hypothetical proteins. The remaining genes not represented in *C. pneumoniae* consist of the tryptophan operon (trpA, B,R), trpC, two predicted thiol protease genes, and 4 genes assigned to the phospholipase-D superfamily.

It is evident that there is a high level of functional conservation between *C. pneumoniae* and *C. trachomatis* as orthologs to *C. trachomatis* genes were identified for 859 (80%) of the predicted coding sequences for *C. pneumoniae*. The level of similarity for individual encoded proteins spans a wide spectrum (22–95% amino acid identity) with an average of 62% amino acid identity between orthologs from the two species. The percent amino acid identity between orthologous chlamydial proteins is similar among functional groups with the highest for proteins associated with translation and the lowest for proteins whose function in chlamydiae is uncharacterized and not related to proteins encoded by other organisms. The gene order of the homologous set of genes in *C. pneumoniae* shows reorganization relative to the genome of *C. trachomatis;* however, there is a high level of synteny for the gene organization of the two genomes. We identified thirty-nine blocks of 2 or more genes whose gene organization is colinear with homologs to *C. trachomatis,* although some of these are inverted. The distribution of genome reorganization is not evenly distributed on the chromosome as the region between *C. pneumoniae* coding sequences 0130–0300 contains substantially more reorganization than other areas of the genome. This region coincides with the predicted chromosome replication terminus.

We identified orthologs of enzymes characterized in other bacteria that account for the essential requirements for DNA replication, repair, transcription and translation including two predicted DNA helicases of the Swi2/Snf2 family found in *C. trachomatis*. Similar to *C. trachomatis*, alternative sigma subunits for RNA polymerase, $\sigma^{28}$ and $\sigma^{54}$, were identified in addition to anti-σ regulatory system factors RsbV, a RsbW-like single-domain histidine kinase, and a RsbU-like protein phosphatase. These findings suggest that the fundamental mechanisms of transcriptional regulation are conserved among *Chlamydia*. The *C. trachomatis* proteins containing SET and SWIB domains, and a SWIB domain fused to the C-terminus of the chlamydial topoisomerase I, not identified outside eukaryotes, are found in *C. pneumoniae* supporting their possible role in the chromatin condensation-decondensation characteristic of the biologically unique chlamydial developmental cycle.

The central metabolic pathways inferred from the *C. pneumoniae* genome sequence are the same as those identified for *C. trachomatis C. pneumoniae* has a glycolytic pathway and a linked tricarboxylic acid cycle, although likely functional, is incomplete as genes for citrate synthase, aconitase, and isocitrate dehydrogenase were not identified. *C. pneumoniae* has a complete glycogen synthesis and degradation system supporting a role for glycogen synthesis and utilization of glucose-derivatives in chlamydial metabolism. Genes encoding essential functions in aerobic respiration are present and electron flux may be supported by pyruvate, succinate, glycerol-3-phosphate, and NADH dehydrogenases, NADH-ubiquinone oxidoreductase and cytochrome oxidase. *C. pneumoniae* also contains the V (vacuolar)-type ATPase operon and the two ATP translocases found in *C. trachomatis*.

The type-III secretion virulence system required for invasion by several pathogenic bacteria and found in the *C. trachomatis* genome in three chromosomal locationsis also present in the *C. pneumoniae* genome. Each of the components is conserved and their relative genomic contexts are conserved. Genes such as a predicted serine/threonine protein kinase and other genes physically linked to genes encoding structural components of the type-III secretion apparatus, but without identified homologs, are also highly similar between the two species suggesting the functional roles in modifying cellular biology are fundamentally conserved.

*Chlamydia*-encoded proteins that are not found in chlamydial organisms but localized to the intracellular chlamydial inclusion membrane are likely essential for the unique intracellular biology and perhaps differences in inclusion morphology observed between species of *Chlamydia*. Several such proteins, termed IncA,B&C, have been characterized for a *C. psittaci* strain (Rockey, et al. *Mol. Microbiol.* 15:617–626 (1995); Rockey et al. *Infect. Immun.* 62:106–112 (1994)). *C. pneumoniae* and *C. trachomatis* encode orthologs to *C. psittaci* IncB and IncC and *C. trachomatis* also contains an ortholog to IncA. *C. pneumoniae* contains two genes that encode proteins with similarity to IncA (CPn0186 and CPn0585), although the level of homology is low suggesting analogous but possibily altered functions.

The tryptophan biosynthesis operon (trpA, trpB, trpR) and trpC identified in *C. trachomatis* is conspicuously missing in the *C. pneumoniae* genome. This represents the entire repertoire of genes associated with tryptophan biosynthesis identified in *C. trachomatis*. Seventeen genes adjacent to the *C. trachomatis* tryptophan operon also were not found in the *C. pneumoniae* genome. This region is the single largest loss of a contiguous genomic segment and includes 4 HKD superfamily encoding genes that encompass a family of proteins related to endonuclease and phospholipase D. These findings may be important for the ability of *Chlamydia* to persist in their hosts and cause disease by eliciting potent, focal and persistent inflammatory responses thought to be essential for pathogenesis.

The *C. pneumoniae* genome contains 187,711 additional nucleotides compared to the *C. trachomatis* genome, and the 214 coding sequences not found in *C. trachomatis* account for most of the increased genome size. Eighty-eight of these genes are found in blocks of >10 genes (11–30 genes/block), 41 are single genes, and the remainder are partnered with at least one other gene. Based upon the observation that ~70% of all the *C. pneumoniae* genes have an identifiable homolog in GenBank, exclusive of *C. trachomatis*, it would be expected that over 150 of the 214 genes should have a homolog in GenBank, many associated with a function. However, only 28 coding sequences have similarity to genes from other organisms. Thus the majority of the genes that are mutually exclusive of *C. trachomatis* (186 of 214), and the 60 of 70 *C. trachomatis* genes that lacked an identifiable homolog in *C. pneumoniae*, do not have detectable homologs to genes from other organisms. We predict that most of the unique genes are essential for specific attributes that define the differential biology, tropism and pathogenesis of *C. trachomatis* and *C. pneumoniae*. Moreover, this suggests that *C. pneumoniae* has more unique biological (i.e., virulence) capacity than *C. trachomatis*. The ability of *C. pneumoniae* to be more invasive and survive in a broader range of host cell types than *C. trachomatis* is consistent with this hypothesis. Not all of the differences in biological capacity may be associated with mutually exclusive genes. One explanation for the significantly lower level of homology between protein sequences assigned as having *C. pneumoniae* and *C. trachomatis* orthologs but no identifiable orthologs in other organisms is that this set of proteins is not only associated with biological requirements specific for *Chlamydia* but this polymorphism may account for differential biology between the two species. The determination of the genome sequence from a representative of the *C psittaci* group will precisely delineate those genes that are mutually exclusive and specific for each species.

The major functionally identifiable addition to the *C. pneumoniae* genome is a large expansion of genes encoding a new family of chlamydial polymorphic membrane proteins (Pmp), alone representing 22% of the increased coding capacity. While the *C. trachomatis* genome has 9 pmp genes, remarkably the *C. pneumoniae* genome contains 21 pmp genes. Most of these genes appear to be amplified in two regions of the genome with three stand-alone genes. Interestingly one of the stand-alone genes is most closely related to the *C. trachomatis* pmpD which is the only stand-alone pmp gene in the *C. trachomatis* genome and it is located with the same relative genomic context, suggesting an essential and conserved function for this paralog. Six Pmp-coding genes are presumably not functional as five contain predicted coding frame-shifts and one is truncated. The amplification of this gene family and the confidently predicted frame-shifts suggest a specific molecular mechanism to promote functional or antigenic diversity. The biological role of this protein family remains enigmatic, although at least one of the proteins in *C. psittaci* related to this family is exposed on the chlamydial surface.

While a function could not be assigned for most of the unique *C. pneumoniae* genes, several have significant similarity to genes from other organisms. Functional assignments could be made for genes encoding GMP synthetase, IMP dehydrogenase, UMP synthase, uridine kinase, biotin synthase pathway proteins, methylthioadenosine nucleosidase, a DNA glycosylase and aromatic amino acid hydroxylase. Thus a complete pathway was identified for biotin biosynthesis. The additional purine and pyrimidine salvage pathway genes presumably reflect metabolic limitations in one of the cell types that *C. pneumoniae* infects or differences in the ability of *C. pneumoniae* to transport precursor nucleosides or nucleotides.

The addition of aromatic amino acid hydroxylase in *C. pneumoniae* is intriguing especially in light of the loss of tryptophan biosynthetic genes and the inability to synthesize other amino acids including phenylalanine. Aromatic amino acid hyroxlyases include three distinct enzymes that function to receptively oxidize phenylalanine to tyrosine, tyrosine to Dopa, and tryptophan to 5-hydroxytryptophan and serotonin. Although the chlamydial protein is similar to proteins of this family and incrementally more closely related to tryptophan hydroxylase, its specific function could not be confidently predicted. We hypothesize that it may be involved in *C. pneumoniae* virulence. Tryptophan hydroxylase has not been previously identified in bacteria and the origin of the chlamydial gene appears to be from eukaryotes. The functional role of an aromatic amino acid hydroxylase for *C. pneumoniae* is linked to the unique intracellular biology of this organism and may represent a key contribution to *C. pneumoniae* persistence and pathogenesis.

It is understood that the examples and embodiments described herein are for illustrative purposes only and that various modifications or changes in light thereof will be suggested to persons skilled in the art and are to be included within the spirit and purview of this application and scope of the appended claims. All publications, patents, and patent applications cited herein are hereby incorporated by reference in their entirety for all purposes.

Table 1 provides functional assignments of *C. pneumoniae* nonprotein-encoding genomic sequences. Table 2 provides functional assignments of protein coding sequences. The Sequence Listing provides the amino acid sequences of the proteins corresponding to the coding sequences (SEQ ID NOS:2–1074).

TABLE 1

| type | SEQ ID NO:1 start position | SEQ ID NO:1 end position | Gene |
|---|---|---|---|
| Ori | 841664 | 841396 | (R) Putative Origin of Replica |
| tmRNA | 138493 | 138074 | (R) tmRNA |
| pRNA | 607342 | 607649 | Ribonuclease P RNA |
| rRNA | 1000564 | 1002115 | 16S rRNA |
| rRNA | 1002415 | 1005278 | 23S rRNA |
| rRNA | 1005393 | 1005509 | 5S rRNA |
| tRNA | 269070 | 269142 | Ala tRNA_1 |
| tRNA | 164318 | 164389 | Asn tRNA |
| tRNA | 296224 | 296151 | (R) Asp tRNA |
| tRNA | 836191 | 836119 | (R) Ala tRNA_2 |
| tRNA | 1030533 | 1030603 | Cys tRNA |
| tRNA | 784896 | 784822 | (R) Glu tRNA |
| tRNA | 781680 | 781610 | (R) Gly tRNA_1 |
| tRNA | 961536 | 961607 | Gly tRNA_2 |
| tRNA | 999949 | 1000023 | His tRNA |
| tRNA | 268992 | 269065 | Ile tRNA |
| tRNA | 672236 | 672318 | Leu tRNA_1 |
| tRNA | 680178 | 680257 | Leu tRNA_2 |
| tRNA | 715889 | 715971 | Leu tRNA_3 |
| tRNA | 739403 | 739486 | Leu tRNA_4 |
| tRNA | 1175863 | 1175944 | Leu tRNA_5 |

TABLE 1-continued

| type | SEQ ID NO:1 start position | SEQ ID NO:1 end position | Gene |
|---|---|---|---|
| tRNA | 784994 | 784922 | (R) Lys tRNA |
| tRNA | 843926 | 843999 | Pro tRNA_2 |
| tRNA | 409922 | 409848 | (R) Pro tRNA_1 |
| tRNA | 631373 | 631445 | Phe tRNA |
| tRNA | 677337 | 677264 | (R) Arg tRNA_2 |
| tRNA | 807413 | 807341 | (R) Arg tRNA_3 |
| tRNA | 877473 | 877400 | (R) Arg tRNA_4 |
| tRNA | 462141 | 462214 | Arg tRNA_1 |
| tRNA | 1085605 | 1085676 | Gln tRNA |
| tRNA | 786780 | 786708 | (R) Thr tRNA_3 |
| tRNA | 89728 | 89657 | (R) Thr tRNA_1 |
| tRNA | 293477 | 293405 | (R) Thr tRNA_2 |
| tRNA | 87522 | 87450 | (R) Met tRNA_1 |
| tRNA | 199301 | 199229 | (R) Met tRNA_2 |
| tRNA | 199390 | 199317 | (R) Met tRNA_3 |
| tRNA | 626904 | 626987 | Ser tRNA_1 |
| tRNA | 708359 | 708440 | Ser tRNA_2 |
| tRNA | 1142034 | 1142117 | Ser tRNA_3 |
| tRNA | 1230028 | 1229945 | (R) Ser tRNA_4 |
| tRNA | 91070 | 90999 | (R) Trp tRNA |
| tRNA | 293399 | 293317 | (R) Tyr tRNA |
| tRNA | 296147 | 296075 | (R) Val tRNA_1 |
| tRNA | 1137389 | 1137462 | Val tRNA_2 |

TABLE 2

| Gene # | From | To | Strand | Gene Function (*C. Trachomatis* Ortholog in parenthesis) |
|---|---|---|---|---|
| CPn0001 | 282 | 4 | R | CT001 hypothetical protein |
| CPn0002 | 573 | 875 | F | gatC-Glu-tRNA Gln Amidotransferase (C subunit)-(CT002) |
| CPn0003 | 895 | 2370 | F | gatA-Glu tRNA Gln Amidotransferase-(CT003) |
| CPn0004 | 2370 | 3833 | F | gatB-(Pet 112) Glu tRNA Gln Amidotransferase (B Subunit) |
| CPn0005 | 4127 | 6892 | F | pmp_1-Polymorphic Outer Membrane Protein G Family |
| CPn0006 | 7293 | 7141 | R | |
| CPn0007 | 7605 | 10496 | F | |
| CPn0008 | 10975 | 11685 | F | |
| CPn0009 | 11815 | 13119 | F | |
| CPn0010 | 13435 | 14325 | F | |
| CPn0010 | 14379 | 15746 | F | frame-shift with 0010 |
| CPn0011 | 15892 | 16614 | F | |
| CPn0012 | 16644 | 18212 | F | |
| CPn0013 | 18584 | 21106 | F | pmp_2-Polymorphic Outer Membrane Protein G Family |
| CPn0014 | 21392 | 21922 | F | pmp_3-Polymorphic Outer Membrane Protein G Family |
| CPn0015 | 21835 | 24174 | F | pmp_3-PMP_3 (frame-shift with 0014) |
| CPn0016 | 24416 | 26188 | F | pmp_4-Polymorphic Outer Membrane Protein G Family |
| CPn0017 | 26094 | 27170 | F | pmp_4-PMP_4 (frame-shift with 0016) |
| CPn0018 | 27522 | 29003 | F | pmp_5-Polymorphic Outer Membrane Protein G Family |
| CPn0019 | 29007 | 30356 | F | pmp_5-PMP_5 (frame-shift with 0018) |
| CPn0020 | 32687 | 30603 | R | Predicted OMP [leader (14) peptide: outer membrane]-(CT351) |
| CPn0021 | 34410 | 32707 | R | Predicted OMP [leader (19) peptide]-(CT350) |
| CPn0022 | 34982 | 34395 | R | maf-(CT349) |
| CPn0023 | 36603 | 35014 | R | yjjK/alr-ABC Transporter Protein ATPase-(CT348) |
| CPn0024 | 37596 | 36661 | R | xerC-Integrase/recombinase-(CT347) |
| CPn0025 | 38604 | 37684 | R | elaC/atsA-Sulphohydrolase/Glycosulfatase-(CT346) |
| CPn0026 | 39625 | 38762 | R | CT345 hypothetical protein-(CT345) |
| CPn0027 | 42234 | 39778 | R | lon-Lon ATP-dependent Protease-(CT344) |
| CPn0028 | 43325 | 42543 | R | |
| CPn0029 | 43755 | 43390 | R | |
| CPn0030 | 43891 | 44529 | F | gcp_1-O-Sialoglycoprotein Endopeptidase_1-(CT343) |

TABLE 2-continued

| Gene # | From | To | Strand | Gene Function (*C. Trachomatis* Ortholog in parenthesis) |
|---|---|---|---|---|
| CPn0031 | 44711 | 44884 | F | rs21-S21 Ribosomal Protein-(CT342) |
| CPn0032 | 44923 | 46098 | F | dnaJ-Heat Shock Protein J-(CT341) |
| CPn0033 | 46138 | 48171 | F | pdhA&B/odbA&odbB-(pyruvate) Oxoisovalerate Dehydrogenase Alpha & _____ Fusion-(CT340) |
| CPn0034 | 49457 | 48210 | R | |
| CPn0035 | 51029 | 49569 | R | CT339 hypothetical protein |
| CPn0036 | 51002 | 51796 | F | CT338 hypothetical protein |
| CPn0037 | 51792 | 52115 | F | ptsH-PTS Phosphocarrier Protein Hpr-(CT337) |
| CPn0038 | 52119 | 53831 | F | ptsI-PTS PEP Phosphotransferase-(CT336) |
| CPn0039 | 54250 | 53963 | R | ybaB-(CT335) |
| CPn0040 | 55643 | 54318 | R | dnaX__1-DNA Pol III Gamma and Tau__1-(CT334) |
| CPn0041 | 55996 | 57342 | F | |
| CPn0042 | 57403 | 58182 | F | |
| CPn0043 | 58447 | 60372 | F | |
| CPn0044 | 60419 | 60778 | F | |
| CPn0045 | 61069 | 62790 | F | |
| CPn0046 | 62790 | 63263 | F | |
| CPn0047 | 63455 | 63652 | F | |
| CPn0048 | 63687 | 65801 | F | *yqfF-Bs conserved hypothetical IM protein |
| CPn0049 | 66296 | 65817 | R | |
| CPn0050 | 66813 | 66499 | R | |
| CPn0051 | 66833 | 67111 | F | |
| CPn0052 | 68005 | 67304 | R | hemC-Porphobilinogen Deaminase-(CT299) |
| CPn0053 | 69344 | 67986 | R | sms-Sms Protein-(CT298) |
| CPn0054 | 70023 | 69313 | R | rnc-Ribonuclease III-(CT297) |
| CPn0055 | 70129 | 70590 | F | CT296 hypothetical protein |
| CPn0056 | 70953 | 72746 | F | mrsA-Phosphomannomutase-(CT295) |
| CPn0057 | 72934 | 73554 | F | sodM-Superoxide Dismutase (Mn)-(CT294) |
| CPn0058 | 73639 | 74562 | F | accD-AcCoA Carboxylase/Transferase Beta-(CT293) |
| CPn0059 | 74616 | 75050 | F | dut-duTP Nucleotidohydrolase-(CT292) |
| CPn0060 | 75055 | 75528 | F | ptsN__1-PTS IIA Protein-(CT291) |
| CPn0061 | 75534 | 76208 | F | ptsN__2-PTS IIA Protein + HTH DNA-Binding Domain-(CT290) |
| CPn0062 | 76308 | 77690 | F | CT289 hypothetical protein |
| CPn0063 | 78112 | 78267 | F | |
| CPn0064 | 78346 | 78576 | F | |
| CPn0065 | 78924 | 80651 | F | CT288 hypothetical protein |
| CPn0066 | 80925 | 82655 | F | |
| CPn0067 | 82953 | 84053 | F | |
| CPn0068 | 84903 | 84331 | R | CT360 hypothetical protein |
| CPn0069 | 85236 | 87086 | F | |
| CPn0070 | 87378 | 87208 | R | |
| CPn0071 | 88045 | 87599 | R | CT325 hypothetical protein |
| CPn0072 | 89061 | 88057 | R | CT324 hypothetical protein |
| CPn0073 | 89356 | 89574 | F | infA-Initiation Factor IF-1-(CT323) |
| CPn0074 | 89774 | 90955 | F | tufA-Elongation Factor Tu-(CT322) |
| CPn0075 | 91102 | 91350 | F | secE-preprotein translocase-(CT321) |
| CPn0076 | 91358 | 91903 | F | nusG-Transcriptional Antitermination-(CT320) |
| CPn0077 | 92013 | 92435 | F | rl11-L11 Ribosomal Protein-(CT319) |
| CPn0078 | 92465 | 93160 | F | rl1-L1 Ribosomal Protein-(CT318) |
| CPn0079 | 93179 | 93688 | F | rl10-L10 Ribosomal Protein-(CT317) |
| CPn0080 | 93735 | 94121 | F | rl7-L7/L12 Ribosomal Protein-(CT316) |
| CPn0081 | 94261 | 98016 | F | rpoB-RNA Polymerase Beta-(CT315) |
| CPn0082 | 98043 | 102221 | F | rpoC-RNA Polymerase Beta'-(CT314) |
| CPn0083 | 102332 | 103312 | F | tal-Transaldolase-(CT313) |
| CPn0084 | 103362 | 103751 | F | predicted ferredoxin-(CT312) |
| CPn0085 | 104506 | 103766 | R | CT311 hypothetical protein |
| CPn0086 | 104904 | 105527 | F | atpE-ATP Synthase Subunit E-(CT310) |
| CPn0087 | 105579 | 106376 | F | CT309 hypothetical protein |
| CPn0088 | 106373 | 108145 | F | atpA-ATP Synthase Subunit A-(CT308) |
| CPn0089 | 108153 | 109466 | F | atpB-ATP Synthase Subunit B-(CT307) |
| CPn0090 | 109454 | 110080 | F | atpD-ATP Synthase Subunit D-(CT306) |
| CPn0091 | 110074 | 112053 | F | atpI-ATP Synthase Subunit I-(CT305) |
| CPn0092 | 112151 | 112573 | F | atpK-ATP Synthase Subunit K-(CT304) |
| CPn0093 | 112509 | 113015 | F | CT303 hypothetical protein |
| CPn0094 | 113152 | 115971 | F | valS-Valyl tRNA Synthetase-(CT302) |
| CPn0095 | 116037 | 118790 | F | pknO-S/T Protein Kinase-(CT301) |
| CPn0096 | 124314 | 118837 | R | uvrA-Excinuclease ABC Subunit A-(CT333) |
| CPn0097 | 124555 | 126006 | F | pyk-Pyruvate Kinase-(CT332) |
| CPn0098 | 127491 | 126091 | R | htrB-Acyltransferase-(CT010) |
| CPn0099 | 127593 | 127865 | F | |
| CPn0100 | 129141 | 127882 | R | CT011 hypothetical protein |
| CPn0101 | 129932 | 129141 | R | ybbP family hypothetical protein-(CT012) |
| CPn0102 | 130123 | 131466 | F | cydA-Cytochrome Oxidase Subunit I-(CT013) |
| CPn0103 | 131480 | 132511 | F | cydB-Cytochrome Oxidase Subunit II-(CT014) |
| CPn0104 | 133875 | 132676 | R | CT017 hypothetical protein |
| CPn0105 | 134847 | 134029 | R | CT016 hypothetical protein |
| CPn0106 | 135091 | 136374 | F | phoH-ATPase-(CT015) |

TABLE 2-continued

| Gene # | From | To | Strand | Gene Function (C. Trachomatis Ortholog in parenthesis) |
|---|---|---|---|---|
| CPn0107 | 137162 | 136392 | R | CT058 hypothetical protein_1 |
| CPn0108 | 137857 | 137303 | R | CT018 |
| CPn0109 | 138655 | 141783 | F | ileS-Isoleucyl-tRNA Synthetase-(CT019) |
| CPn0110 | 143734 | 141827 | R | lepB-Signal Peptidase I-(CT020) |
| CPn0111 | 144686 | 143934 | R | CT021 hypothetical protein |
| CPn0112 | 144767 | 145093 | F | rl31-L31 Ribosomal Protein-(CT022) |
| CPn0113 | 145335 | 146405 | F | pfrA-Peptide Chain Releasing Factor (RF-1)-(CT023) |
| CPn0114 | 146398 | 147261 | F | hemK-A/G specific methylase-(CT024) |
| CPn0115 | 147279 | 148622 | F | ffh-Signal Recognition Particle GTPase-(CT025) |
| CPn0116 | 148616 | 148972 | F | rs16-S16 Ribosomal Protein-(CT026) |
| CPn0117 | 148989 | 150071 | F | trmD-tRNA (guanine N-1)-Methyltransferase-(CT027) |
| CPn0118 | 150102 | 150464 | F | rl19-L19 Ribosomal Protein-(CT028) |
| CPn0119 | 150523 | 151164 | F | rnhB_1-Ribonuclease HII_1-(CT029) |
| CPn0120 | 151164 | 151778 | F | gmk-GMP Kinase-(CT030) |
| CPn0121 | 151778 | 152068 | F | CT031 hypothetical protein |
| CPn0122 | 152071 | 153723 | F | metG-Methionyl-tRNA Synthetase-(CT032) |
| CPn0123 | 155969 | 153774 | R | recD_1-Exodeoxyribonuclease V (Alpha Subunit)_1-(CT033) |
| CPn0124 | 156614 | 158068 | F | |
| CPn0125 | 158096 | 158605 | F | |
| CPn0126 | 158809 | 161085 | F | |
| CPn0127 | 162143 | 161130 | R | ytfF-Cationic Amino Acid Transporter-(CT034) |
| CPn0128 | 162277 | 163053 | F | bpl1-Biotin Protein Ligase-(CT035) |
| CPn0129 | 163717 | 163064 | R | similarity to CT036 |
| CPn0130 | 164245 | 163751 | R | |
| CPn0131 | 164549 | 165580 | F | |
| CPn0132 | 165587 | 166561 | F | |
| CPn0133 | 167334 | 166564 | R | CHLPS hypothetical protein-(CT109) |
| CPn0134 | 169098 | 167467 | R | groEL_1-HSP-60_1-(CT110) |
| CPn0135 | 169448 | 169143 | R | groES-10 KDa Chaperonin-(CT111) |
| CPn0136 | 171401 | 169569 | R | pepF-Oligopeptidase-(CT112) |
| CPn0137 | 172254 | 171502 | R | ybgI-ACR family-(CT108) |
| CPn0138 | 174019 | 172700 | R | hemL-Glutamate-1-semialdehyde-2.1-aminomutase-(CT210) |
| CPn0139 | 174656 | 174093 | R | yqgE-(CT210) |
| CPn0140 | 175110 | 174673 | R | yqdE-(CT212) |
| CPn0141 | 175802 | 175110 | R | rpiA-Ribose-5-P Isomerase A-(CT213) |
| CPn0142 | 176091 | 175816 | R | |
| CPn0143 | 177335 | 176214 | R | *yxjG_Bs_1 Hypothetical Protein |
| CPn0144 | 177963 | 180560 | F | clpB-Clp Protease ATPase-(CT113) |
| CPn0145 | 180777 | 182369 | F | CT114 hypothetical protein |
| CPn0146 | 182613 | 183095 | F | |
| CPn0147 | 183225 | 183671 | F | |
| CPn0148 | 183846 | 185702 | F | pkn1-S/T Protein Kinase-(CT145) |
| CPn0149 | 185715 | 187700 | F | dnlJ-DNA Ligase-(CT146) |
| CPn0150 | 187834 | 192444 | F | CT147 hypothetical protein |
| CPn0151 | 194142 | 192625 | R | mhpA-Monooxygenase-(CT148) |
| CPn0152 | 195265 | 194318 | R | CT149 hypothetical protein |
| CPn0153 | 195433 | 197892 | F | leuS-Leucyl tRNA Synthetase-(CT209) |
| CPn0154 | 197892 | 199202 | F | gseA-KDO Transferase-(CT208) |
| CPn0155 | 199691 | 199488 | R | |
| CPn0156 | 200117 | 199770 | R | |
| CPn0157 | 200723 | 200298 | R | |
| CPn0158 | 201430 | 200894 | R | |
| CPn0159 | 201772 | 201467 | R | |
| CPn0160 | 203791 | 202127 | R | pfkA_1-Fructose-6-P Phosphotransferase_1-(CT207) |
| CPn0161 | 204622 | 203798 | R | predicted acyltransferase family-(CT206) |
| CPn0162 | 205828 | 204803 | R | |
| CPn0163 | 206026 | 206394 | F | |
| CPn0164 | 206498 | 206998 | F | |
| CPn0165 | 206998 | 207582 | F | |
| CPn0166 | 207630 | 207962 | F | |
| CPn0167 | 208306 | 207977 | R | |
| CPn0168 | 208641 | 208417 | R | |
| CPn0169 | 209501 | 208710 | R | |
| CPn0170 | 211026 | 210025 | R | |
| CPn0171 | 212435 | 211149 | R | *guaA-GMP Synthase |
| CPn0172 | 213177 | 212440 | R | *guaB/impD-Inosine 5'-monophosphase dehydrogenase (COOH-terminal region only) |
| CPn0173 | 213987 | 213715 | R | |
| CPn0174 | 214257 | 214724 | F | |
| CPn0175 | 214898 | 215275 | F | |
| CPn0176 | 215286 | 216518 | F | CT153 hypothetical protein |
| CPn0177 | 217459 | 216608 | R | |
| CPn0178 | 218052 | 217789 | R | |
| CPn0179 | 218403 | 218056 | R | |
| CPn0180 | 218851 | 218355 | R | |
| CPn0181 | 219175 | 218777 | R | |
| CPn0182 | 220695 | 219334 | R | accC-Biotin Carboxylase-(CT124) |
| CPn0183 | 221195 | 220695 | R | accB-Biotin Carboxyl Carrier Protein-(CT123) |

TABLE 2-continued

| Gene # | From | To | Strand | Gene Function (C. Trachomatis Ortholog in parenthesis) |
|---|---|---|---|---|
| CPn0184 | 221775 | 221221 | R | efp_1-Elongation Factor P_1-(CT122) |
| CPn0185 | 222451 | 221765 | R | rpe/araD-Ribulose-P Epimerase-(CT121) |
| CPn0186 | 222899 | 224068 | F | *similarity to Cps IncA_1-(CT119) |
| CPn0187 | 224248 | 225045 | F | predicted methylase-(CT133) |
| CPn0188 | 225111 | 226400 | F | CT132 hypothetical protein |
| CPn0189 | 226400 | 229825 | F | CT131 homolog-(Possible Transmembrane Protein) |
| CPn0190 | 229919 | 231274 | F | |
| CPn0191 | 231991 | 231314 | R | glnQ-ABC Amino Acid Transporter ATPase-(CT130) |
| CPn0192 | 232634 | 231984 | R | glnP-ABC Amino Acid Transporter Permease-(CT129) |
| CPn0193 | 233126 | 232686 | R | *argR-Arginine Repressor |
| CPn0194 | 233210 | 234241 | F | gcp_2-O-Sialoglycoprotein Endopeptidase_2-(CT197) |
| CPn0195 | 234190 | 235785 | F | oppA_1-Oligopeptide Binding Protein_1 |
| CPn0196 | 235939 | 237519 | F | oppA_2-Oligopeptide Binding Protein_2-(CT198) |
| CPn0197 | 237578 | 238882 | F | oppA_3-Oligopeptide Binding Protein_3 |
| CPn0198 | 239169 | 240746 | F | oppA_4-Oligopeptide Binding Protein_4 |
| CPn0199 | 241042 | 241983 | F | oppB_1-Oligopeptide Permease_1-(CT199) |
| CPn0200 | 242017 | 242868 | F | oppC_1-Oligopeptide Permease_1-(CT200) |
| CPn0201 | 242864 | 243715 | F | oppD-Oligopeptide Transport ATPase-(CT201) |
| CPn0202 | 243715 | 244500 | F | oppF-Oligopeptide Transport ATPase-(CT202) |
| CPn0203 | 245008 | 245802 | F | |
| CPn0204 | 245817 | 246002 | F | |
| CPn0205 | 246133 | 246327 | F | |
| CPn0206 | 246409 | 247161 | F | CT203 hypothetical protein |
| CPn0207 | 247208 | 248617 | F | ybhI/sodiT1-Oxoglutarate/Malate Translocator-(CT204) |
| CPn0208 | 248953 | 250602 | F | pfkA_2-Fructose-6-P Phosphotransferase_2-(CT205) |
| CPn0209 | 251036 | 251272 | F | |
| CPn0210 | 252384 | 251440 | R | |
| CPn0211 | 252756 | 252463 | R | |
| CPn0212 | 254066 | 252888 | R | |
| CPn0213 | 254342 | 254190 | R | |
| CPn0214 | 255657 | 254446 | R | |
| CPn0215 | 257015 | 255759 | R | |
| CPn0216 | 257608 | 257174 | R | |
| CPn0217 | 257896 | 258579 | F | ypdP-(CT140) |
| CPn0218 | 259058 | 258582 | R | |
| CPn0219 | 259357 | 260472 | F | tgt-Queuine tRNA Ribosyl Transferase-(CT193) |
| CPn0220 | 260696 | 261238 | F | |
| CPn0221 | 261657 | 262064 | F | |
| CPn0222 | 262504 | 262842 | F | *weak similarity to Bacteriophage CHP1 (Orf4) |
| CPn0223 | 262956 | 263333 | F | |
| CPn0224 | 263435 | 263674 | F | |
| CPn0225 | 263873 | 264541 | F | |
| CPn0226 | 264566 | 264967 | F | |
| CPn0227 | 265416 | 265009 | R | dsbB-Disulfide bond Oxidoreductase-(CT176) |
| CPn0228 | 266110 | 265412 | R | dsbG-Disulfide Bond Chaperone-(CT177) |
| CPn0229 | 266328 | 267560 | F | CT178 hypothetical protein |
| CPn0230 | 268253 | 267576 | R | CT179 hypothetical protein |
| CPn0231 | 268957 | 268253 | R | tauB-ABC Transport ATPase (Nitrate/Fe)-(CT180) |
| CPn0232 | 270122 | 269232 | R | *similarity to 5'-Methylthioadenosine/S-Adenosylhomocysteine Nucleosidase |
| CPn0233 | 270424 | 270248 | R | |
| CPn0234 | 271240 | 270548 | R | CT181 hypothetical protein |
| CPn0235 | 271416 | 272177 | F | kdsB-deoxyoctulonosic Acid Synthetase-(CT182) |
| CPn0236 | 272156 | 273766 | F | pyrG-CTP Synthetase-(CT183) |
| CPn0237 | 273762 | 274214 | F | yggF Family-(CT184) |
| CPn0238 | 274303 | 275838 | F | rwf-Glucose-6-P Dehydrogenase-(CT185) |
| CPn0239 | 275899 | 276672 | F | devB-Glucose-6-P Dehydrogenase (DevB family)-(CT186) |
| CPn0240 | 277861 | 276698 | R | |
| CPn0241 | 279354 | 278203 | R | |
| CPn0242 | 279918 | 279487 | R | |
| CPn0243 | 280555 | 280133 | R | |
| CPn0244 | 280918 | 281556 | F | adk-Adenylate Kinase-(CT128) |
| CPn0245 | 281645 | 282499 | F | ydhO-Polysaccharide Hydrolase-Invasin Repeat Family-(CT127) |
| CPn0246 | 282952 | 282551 | R | rs9-S9 Ribosomal Protein-(CT126) |
| CPn0247 | 283415 | 282969 | R | rl13-L13 Ribosomal Protein-(CT125) |
| CPn0248 | 284327 | 283650 | R | ycfV/ybbA-ABC Transporter ATPase-(CT152) |
| CPn0249 | 285841 | 284333 | R | CT151 hypothetical protein |
| CPn0250 | 286057 | 285902 | R | rl33-L33 Ribosomal Protein-(CT150) |
| CPn0251 | 286060 | 287559 | F | *conserved hypothetical protein |
| CPn0252 | 288112 | 287576 | R | CT144 hypothetical protein (frame-shift with 0253?) |
| CPn0253 | 288456 | 287950 | R | CT144 hypothetical protein_1 |
| CPn0254 | 289262 | 288459 | R | CT143 hypothetical protein_1 |
| CPn0255 | 290165 | 289329 | R | CT142 hypothetical protein_1 |
| CPn0256 | 291264 | 290398 | R | CT144 hypothetical protein_2 |
| CPn0257 | 292127 | 291267 | R | CT143 hypothetical protein_2 |
| CPn0258 | 292534 | 292133 | R | CT142 hypothetical protein (frame-shift with 0259?) |
| CPn0259 | 292986 | 292441 | R | CT142 hypothetical protein_2 |

TABLE 2-continued

| Gene # | From | To | Strand | Gene Function (C. Trachomatis Ortholog in parenthesis) |
|---|---|---|---|---|
| CPn0260 | 294045 | 293548 | R | secA_1-Protein Translocase Subunit_1-(CT141) |
| CPn0261 | 294302 | 295033 | F | ydaO-PP-Loop Superfamily ATPase-(CT217) |
| CPn0262 | 295091 | 295933 | F | surE-SurE-like Acid Phosphatase-(CT218) |
| CPn0263 | 296249 | 297136 | F | yqfU hypothetical protein-(CT221) |
| CPn0264 | 297730 | 297155 | R | ubiD-Phenylacrylate Decarboxylase-(CT220) |
| CPn0265 | 298620 | 297730 | R | ubiA-Benzoate Octaphenyltransferase-(CT219) |
| CPn0266 | 299184 | 299876 | F | |
| CPn0267 | 300122 | 300910 | F | |
| CPn0268 | 300935 | 301318 | F | |
| CPn0269 | 302450 | 301476 | R | Dipeptidase-(CT138) |
| CPn0270 | 303325 | 302468 | R | ywlC-SuA5 Superfamily-related Protein-(CT137) |
| CPn0271 | 303634 | 304362 | F | Lysophospholipase esterase-(CT136) |
| CPn0272 | 305233 | 304340 | R | dnaX_2-DNA Pol III Gamma and Tau_2-(CT187) |
| CPn0273 | 305844 | 305227 | R | tdk-Thymidylate Kinase-(CT188) |
| CPn0274 | 308353 | 305852 | R | gyrA_1-DNA Gyrase Subunit A_1-(CT189) |
| CPn0275 | 310786 | 308372 | R | gyrB_1-DNA Gyrase Subunit B_1-(CT190) |
| CPn0276 | 311137 | 310793 | R | CT191 hypothetical protein |
| CPn0277 | 311910 | 311404 | R | |
| CPn0278 | 312875 | 312060 | R | *conserved outer membrane lipoprotein protein |
| CPn0279 | 313537 | 312875 | R | *Possible ABC Transporter Permease Protein |
| CPn0280 | 314572 | 313550 | R | dppF-Dipeptide Transporter ATPase-(CT689) |
| CPn0281 | 315057 | 316103 | F | dhnA-Predicted 1,6-Fructose Biphosphaid Aldolase (dehydrin family)-(CT215) |
| CPn0282 | 316126 | 317529 | F | xasA/gadC-Amino Acid Transporter-(CT216) |
| CPn0283 | 318497 | 317532 | R | |
| CPn0284 | 319045 | 318551 | R | |
| CPn0285 | 320595 | 319051 | R | |
| CPn0286 | 322059 | 320650 | R | mgtE-Mg++ Transporter (CBS Domain)-(CT194) |
| CPn0287 | 324221 | 322089 | R | |
| CPn0288 | 325716 | 324571 | R | CT195 hypothetical protein |
| CPn0289 | 325812 | 326996 | F | aaaT-Neutral Amino Acid (Glutamate) Transporter-(CT230) |
| CPn0290 | 327042 | 328523 | F | Na-dependent Transporter-(CT231) |
| CPn0291 | 328667 | 329194 | F | incB-Inclusion Membrane Protein B-(CT232) |
| CPn0292 | 329228 | 329836 | F | incC-Inclusion Membrane Protein C-(CT233) |
| CPn0293 | 329949 | 332723 | F | CT234 hypothetical protein |
| CPn0294 | 333092 | 333502 | F | cAMP-Dependent Protein Kinase Regulatory Subunit-(CT235) |
| CPn0295 | 333863 | 333627 | R | acpP-Acyl Carrier Protein-(CT236) |
| CPn0296 | 334765 | 334022 | R | fabG-Oxoacyl (Carrier Protein) Reductase-(CT237) |
| CPn0297 | 335697 | 334774 | R | fabD-Malonyl Acyl Carrier Transcyclase-(CT238) |
| CPn0298 | 336721 | 335717 | R | fabH-Oxoacyl Carrier Protein Synthase III-(CT239) |
| CPn0299 | 336816 | 337415 | F | recR-Recombination Protein-(CT240) |
| CPn0300 | 337783 | 340152 | F | yaeT-Omp85 Analog-(CT241) |
| CPn0301 | 340250 | 340762 | F | (OmpH-Like Outer Membrane Protein)-(CT242) |
| CPn0302 | 340787 | 341866 | F | lpxD-UDP Glucosamine N-Acyltransferase-(CT243) |
| CPn0303 | 342958 | 341921 | R | CT244 hypothetical protein |
| CPn0304 | 343133 | 344158 | F | pdhA/odpA-Pyruvate Dehydrogenase Alpha-(CT245) |
| CPn0305 | 344154 | 345137 | F | pdhB/odpB-Pyruvate Dehydrogenase Beta-(CT246) |
| CPn0306 | 345145 | 346431 | F | pdhC-Dihydrolipoamide Acetyltransferase-(CT247) |
| CPn0307 | 348986 | 346515 | R | glgP-Glycogen Phosphorylase-(CT248) |
| CPn0308 | 349234 | 349596 | F | similarity to CT249 |
| CPn0309 | 350974 | 349595 | R | dnaA_1-Replication Initiation Protein_1-(CT250) |
| CPn0310 | 353433 | 351049 | R | 60IM-60 kDa Inner Membrane Protein-(CT251) |
| CPn0311 | 354438 | 353575 | R | lgt-Prolipoprotein Diacylglycerol Transferase-(CT252) |
| CPn0312 | 354524 | 354976 | F | CT101 hypothetical protein |
| CPn0313 | 354990 | 355355 | F | acpS-Acyl-carrier Protein Synthase-(CT100) |
| CPn0314 | 356285 | 355353 | R | trxB-Thioredoxin Reductase-(CT099) |
| CPn0315 | 356977 | 358716 | F | rs1-S1 Ribosomal Protein-(CT098) |
| CPn0316 | 358820 | 360121 | F | nusA-N Utilization Protein A-(CT097) |
| CPn0317 | 360081 | 362750 | F | infB-Initiation Factor-2-(CT096) |
| CPn0318 | 362767 | 363126 | F | rbfA-Ribosome Binding Factor A-(CT095) |
| CPn0319 | 363175 | 363879 | F | truB-tRNA Pseudouridine Synthase-(CT094) |
| CPn0320 | 363860 | 364783 | F | ribF-FAD Synthase-(CT093) |
| CPn0321 | 365858 | 364767 | R | ychF-GTP Binding Protein-(CT092) |
| CPn0322 | 366249 | 367328 | F | yscU-YopS Translocation Protein U-(CT091) |
| CPn0323 | 367331 | 369460 | F | lcrD-Low Calcium Response D-(CT090) |
| CPn0324 | 369492 | 370688 | F | lcrE-Low Calcium Response E-(CT089) |
| CPn0325 | 370708 | 371148 | F | sycE-Secretion Chaperone-(CT088) |
| CPn0326 | 371148 | 372725 | F | malQ-Glucanotransferase-(CT087) |
| CPn0327 | 372945 | 373211 | F | rl28-L28 Ribosomal Protein-(CT086) |
| CPn0328 | 373241 | 374992 | F | CT085 hypothetical protein |
| CPn0329 | 375088 | 376146 | F | Phopholipase D Superfamily [leader (33) peptide]-(CT084) |
| CPn0330 | 376675 | 376202 | R | CT083 hypothetical protein |
| CPn0331 | 378437 | 376701 | R | CT082 hypothetical protein |
| CPn0332 | 378655 | 378536 | R | CHLTR T2 Protein-(CT081) |
| CPn0333 | 379090 | 378800 | R | ltuB-(CT080) |
| CPn0334 | 379311 | 379823 | F | CT079 similarity |
| CPn0335 | 379817 | 380674 | F | folD-Methylene Tetrahydrofolate Dehydrogenase-(CT078) |
| CPn0336 | 380650 | 381591 | F | yojL-(CT077) |

TABLE 2-continued

| Gene # | From | To | Strand | Gene Function (C. Trachomatis Ortholog in parenthesis) |
|---|---|---|---|---|
| CPn0337 | 382027 | 381575 | R | smpB-Small Protein B-(CT076) |
| CPn0338 | 382278 | 383375 | F | dnaN-DNA Pol III (beta chain)-(CT075) |
| CPn0339 | 383420 | 384034 | F | recF-ABC superfamily ATPase-(CT074) |
| CPn0340 | 383842 | 384156 | F | (frame-shift with 0339) |
| CPn0341 | 384160 | 384495 | F | (frame-shift with 0340) |
| CPn0342 | 384622 | 385062 | F | predicted OMP [leader (19) peptide]-(CT073) |
| CPn0343 | 384999 | 385595 | F | (frame-shift with 0342?) |
| CPn0344 | 387420 | 385558 | R | yaeL-Metalloprotease-(CT072) |
| CPn0345 | 388572 | 387436 | R | yaeM-(CT071) |
| CPn0346 | 389675 | 388704 | R | troD/ytgD-Integral Membrane Protein-(CT070) |
| CPn0347 | 391021 | 389678 | R | troC/ytgC-Integral Membrane Protein-(CT069) |
| CPn0348 | 391803 | 391027 | R | troB/ytgB-ABC transporter ATPase-(CT068) |
| CPn0349 | 392770 | 391790 | R | troA/ytgA-Solute Protein Binding Family-(CT067) |
| CPn0350 | 393181 | 393684 | F | CT066 hypothetical protein |
| CPn0351 | 393888 | 395432 | F | adt_1-ADP-ATP Translocase_1-(CT065) |
| CPn0352 | 395574 | 396830 | F | |
| CPn0353 | 396893 | 397135 | F | |
| CPn0354 | 397167 | 398507 | F | |
| CPn0355 | 399889 | 398591 | R | |
| CPn0356 | 400459 | 400109 | R | |
| CPn0357 | 401317 | 400469 | R | |
| CPn0358 | 401751 | 401578 | R | |
| CPn0359 | 402012 | 403817 | F | lepA-GTPase-(CT064) |
| CPn0360 | 405358 | 403922 | R | gnd-6-Phosphogluconate Dehydrogenase-(CT063) |
| CPn0361 | 406647 | 405382 | R | tyrS-tyrosyl tRNA Synthetase-(CT062) |
| CPn0362 | 407825 | 407055 | R | fliA/rpsD-Sigma-28/WhiG Family-(CT061) |
| CPn0363 | 409688 | 407943 | R | flhA-Flagellar Secretion Protein-(CT060) |
| CPn0364 | 409966 | 410238 | F | |
| CPn0365 | 410528 | 411544 | F | fer4-Ferredoxin IV-(CT059) |
| CPn0366 | 411976 | 412440 | F | |
| CPn0367 | 413102 | 413836 | F | |
| CPn0368 | 413790 | 414107 | F | |
| CPn0369 | 414351 | 415562 | F | CT058 hypothetical protein_2 |
| CPn0370 | 415800 | 416912 | F | CT058 hypothetical protein_3 |
| CPn0371 | 417147 | 417503 | F | |
| CPn0372 | 417687 | 418001 | F | |
| CPn0373 | 418380 | 420218 | F | gcpE-(CT057) |
| CPn0374 | 420218 | 420961 | F | CT056 hypothetical protein |
| CPn0375 | 421121 | 421615 | F | |
| CPn0376 | 421854 | 422294 | F | |
| CPn0377 | 423438 | 422347 | R | sucB_1-Dihydrolipoamide Succinyltransferase_1-(CT055) |
| CPn0378 | 426168 | 423445 | R | sucA-Oxoglutarate Dehydrogenase-(CT054) |
| CPn0379 | 426322 | 426765 | F | CT053 hypothetical protein |
| CPn0380 | 426758 | 427876 | F | hemN_1-Coproporphyrinogen III Oxidase_1-(CT052) |
| CPn0381 | 429809 | 428037 | R | CT326 similarity |
| CPn0382 | 430749 | 430036 | R | yabC/yraL-SAM-Dependent Methytransferase-(CT048) |
| CPn0383 | 431693 | 430749 | R | CT047 hypothetical protein |
| CPn0384 | 432377 | 431862 | R | hctB-Histone-like Protein 2-(CT046) |
| CPn0385 | 434018 | 432522 | R | pepA-Leucyl Aminopeptidase A-(CT045) |
| CPn0386 | 434525 | 434046 | R | ssb-SS DNA Binding Protein-(CT044) |
| CPn0387 | 435196 | 434699 | R | CT043 hypothetical protein |
| CPn0388 | 435329 | 437320 | F | glgX-Glycogen Hydrolase (debranching)-(CT042) |
| CPn0389 | 438134 | 437319 | R | CT041 hypothetical protein |
| CPn0390 | 439144 | 438134 | R | ruvB-Holliday Junction Helicase-(CT040) |
| CPn0391 | 439692 | 439510 | R | |
| CPn0392 | 439814 | 440383 | F | dcd-dCTP Deaminase-(CT039) |
| CPn0393 | 440379 | 440723 | F | CT038 hypothetical protein |
| CPn0394 | 440736 | 441968 | F | tlyC_1-CBS Domain protein (Hemolysin Homolog)_1-(CT256) |
| CPn0395 | 441964 | 443175 | F | CT257 hypothetical protein |
| CPn0396 | 444353 | 443241 | R | yhfO-NifS-related protein-(CT258) |
| CPn0397 | 445115 | 444381 | R | PP2C phosphatase family-(CT259) |
| CPn0398 | 445533 | 445700 | F | |
| CPn0399 | 445879 | 446523 | F | CT253 hypothetical protein |
| CPn0400 | 446536 | 447306 | F | CT254 hypothetical protein |
| CPn0401 | 447884 | 447495 | R | CT255 hypothetical protein |
| CPn0402 | 448994 | 447888 | R | mutY-Adenine Glycosylase-(CT107) |
| CPn0403 | 449015 | 449710 | F | yceC-predicted pseudouridine synthetase family-(CT106) |
| CPn0404 | 450887 | 449871 | R | |
| CPn0405 | 451739 | 450966 | R | CT105 hypothetical protein |
| CPn0406 | 451969 | 452865 | F | fabI-Enoyl-Acyl-Carrier Protein Reductase-(CT104) |
| CPn0407 | 453742 | 452858 | R | HAD superfamily hydrolase/phosphatase-(CT103) |
| CPn0408 | 454105 | 454581 | F | CT102 hypothetical protein |
| CPn0409 | 454645 | 455127 | F | CT260 hypothetical protein |
| CPn0410 | 455123 | 455833 | F | dnaQ_1-DNA Pol III Epsilon Chain_1-(CT261) |
| CPn0411 | 455833 | 456609 | F | CT262 hypothetical protein |
| CPn0412 | 456590 | 457246 | F | CT263 hypothetical protein |
| CPn0413 | 459203 | 457227 | R | msbA-Transport ATP Binding Protein-(CT264) |

TABLE 2-continued

| Gene # | From | To | Strand | Gene Function (*C. Trachomatis* Ortholog in parenthesis) |
|---|---|---|---|---|
| CPn0414 | 460143 | 459172 | R | accA-AcCoA Carboxylase/Transferase Alpha-(CT265) |
| CPn0415 | 461498 | 460221 | R | CT266 hypothetical protein |
| CPn0416 | 461856 | 461557 | R | himD/ihfA-Integration Host Factor Alpha-(CT267) |
| CPn0417 | 463035 | 462244 | R | amiA-N-Acetylmuramoyl Alanine Amidase-(CT268) |
| CPn0418 | 464401 | 462953 | R | murE-N-Acetylmuramoylalanylglutamyl DAP Ligase-(CT269) |
| CPn0419 | 466834 | 464876 | R | pbp3-transglycolase/transpeptidase-(CT270) |
| CPn0420 | 467108 | 466824 | R | CT271 hypothetical protein |
| CPn0421 | 467998 | 467108 | R | yabC-PBP2B Family methyltransferase-(CT272) |
| CPn0422 | 468242 | 468784 | F | CT273 hypothetical protein |
| CPn0423 | 468791 | 469216 | F | CT274 hypothetical protein |
| CPn0424 | 469612 | 470961 | F | dnaA_2-Replication Initiation Factor_2-(CT275) |
| CPn0425 | 470980 | 471564 | F | CT276 hypothetical proteins |
| CPn0426 | 472111 | 471536 | R | CT277 similarity |
| CPn0427 | 472207 | 473715 | F | nqr2-NADH (Ubiquinone) Dehydrogenase-(CT278) |
| CPn0428 | 473722 | 474681 | F | nqr3-NADH (Ubiquinone) Oxidoreductase, Gamma-(CT279) |
| CPn0429 | 474681 | 475319 | F | nqr4-NADH (Ubiquinone) Reductase 4-(CT280) |
| CPn0430 | 475326 | 476093 | F | nqr5-NADH (Ubiquinone) Reductase 5-(CT281) |
| CPn0431 | 476483 | 476151 | R | |
| CPn0432 | 476816 | 476514 | R | |
| CPn0433 | 477273 | 476929 | R | gcsH-Glycine Cleavage System H Protein-(CT282) |
| CPn0434 | 479462 | 477276 | R | CT283 hypothetical protein |
| CPn0435 | 480902 | 479475 | R | Phospholipase D superfamily [uncleavable leader peptide]-(CT284) |
| CPn0436 | 481618 | 480902 | R | lplA-Lipoate Protein Ligase-Like Protein-(CT285) |
| CPn0437 | 481816 | 484350 | F | clpC-ClpC Protease-(CT286) |
| CPn0438 | 485416 | 484334 | R | ycbF-PP-loop superfamily ATPase-(CT287) |
| CPn0439 | 485553 | 486077 | F | |
| CPn0440 | 486105 | 486740 | F | |
| CPn0441 | 486891 | 487838 | F | CT007 hypothetical protein |
| CPn0442 | 488013 | 488528 | F | CT006 hypothetical protein |
| CPn0443 | 488729 | 489979 | F | CT005 hypothetical protein |
| CPn0444 | 490287 | 494507 | F | pmp_6-Polymorphic Outer Membrane Protein G/I Family |
| CPn0445 | 494772 | 497579 | F | pmp_7-Polymorphic Outer Membrane Protein G Family |
| CPn0446 | 497626 | 500415 | F | pmp_8-Polymorphic Outer Membrane Protein G Family |
| CPn0447 | 500568 | 503351 | F | pmp_9-Polymorphic Outer Membrane Protein G/I Family |
| CPn0448 | 504810 | 503698 | R | *yxjG_Bs_2 Hypothetical Protein |
| CPn0449 | 507231 | 505330 | R | pmp_10-PMP_10 (Frame-shift with 0451) |
| CPn0450 | 508112 | 507180 | R | pmp_10-Polymorphic Outer Membrane Protein G Family |
| CPn0451 | 508275 | 511058 | F | pmp_11-Polymorphic Outer Membrane Protein G Family |
| CPn0452 | 511319 | 512860 | F | pmp_12-Polymorphic Outer Membrane Protein A/I Family (truncated) |
| CPn0453 | 513234 | 516152 | F | pmp_13-Polymorphic Outer Membrane Protein G Family |
| CPn0454 | 516182 | 519115 | F | pmp_14-Polymorphic Outer Membrane Protein H Family |
| CPn0455 | 520348 | 519458 | R | |
| CPn0456 | 521532 | 520327 | R | |
| CPn0457 | 523865 | 522120 | R | |
| CPn0458 | 526320 | 524236 | R | |
| CPn0459 | 527005 | 526619 | R | |
| CPn0460 | 527840 | 526992 | R | |
| CPn0461 | 528638 | 527844 | R | |
| CPn0462 | 531052 | 529037 | R | |
| CPn0463 | 532357 | 531191 | R | |
| CPn0464 | 532842 | 532366 | R | |
| CPn0465 | 533212 | 532871 | R | |
| CPn0466 | 533724 | 536537 | F | pmp_15-Polymorphic Outer Membrane Protein E Family |
| CPn0467 | 536633 | 539434 | F | pmp_16-Polymorphic Outer Membrane Protein E Family |
| CPn0468 | 539632 | 540432 | F | pmp_17-Polymorphic Outer Membrane Protein E Family |
| CPn0469 | 540399 | 541460 | F | pmp_17-Polymorphic Outer Membrane Protein (Frame-shift with 0469) |
| CPn0470 | 541357 | 542532 | F | pmp_17-Polymorphic Outer Membrane Protein (Frame-shift with 0470) |
| CPn0471 | 542564 | 545401 | F | pmp_18-Polymorphic Outer Membrane Protein E/F Family |
| CPn0472 | 547905 | 545581 | R | |
| CPn0473 | 549593 | 548070 | R | |
| CPn0474 | 551573 | 549807 | R | CT365 hypothetical protein |
| CPn0475 | 553844 | 551685 | R | glgB-Glucan Branching Enzyme-(CT866) |
| CPn0476 | 554844 | 553858 | R | CT865 hypothetical protein |
| CPn0477 | 556106 | 554844 | R | *yqeV_Bs Hypothetical Protein |
| CPn0478 | 557625 | 556210 | R | hflX-GTP Binding Protein-(CT379) |
| CPn0479 | 558425 | 557616 | R | phnP-Metal Dependent Hydrolase-(CT380) |
| CPn0480 | 559303 | 558650 | R | CT383 hypothetical protein |
| CPn0481 | 560946 | 559339 | R | |
| CPn0482 | 561737 | 560961 | R | artJ-Arginine Periplasmic Binding Protein-(CT381) |
| CPn0483 | 561836 | 564964 | F | |
| CPn0484 | 564970 | 565824 | F | aroG-Deoxyheptonate Aldolase-(CT382) |
| CPn0485 | 566038 | 566229 | F | CT382.1 hypothetical protein |
| CPn0486 | 567784 | 566405 | R | *hypothetical proline permease |
| CPn0487 | 569740 | 568112 | R | CT384 hypothetical protein |
| CPn0488 | 570096 | 569767 | R | hitA-HIT Family Hydrolase-(CT385) |
| CPn0489 | 570965 | 570096 | R | CT386 hypothetical protein |
| CPn0490 | 571279 | 573333 | F | CT387 hypothetical protein |

TABLE 2-continued

| Gene # | From | To | Strand | Gene Function (C. Trachomatis Ortholog in parenthesis) |
|---|---|---|---|---|
| CPn0491 | 574352 | 573336 | R | CT389 hypothetical protein |
| CPn0492 | 574652 | 574804 | F | |
| CPn0493 | 575004 | 574855 | R | |
| CPn0494 | 575364 | 575146 | R | |
| CPn0495 | 575603 | 576793 | F | aspC-Aspartate Aminotransferase-(CT390) |
| CPn0496 | 576793 | 577812 | F | CT391 hypothetical protein |
| CPn0497 | 578089 | 577820 | R | CT388 hypothetical protein |
| CPn0498 | 579035 | 578085 | R | |
| CPn0499 | 580359 | 579205 | R | |
| CPn0500 | 580659 | 582362 | F | proS-Prolyl tRNA Synthetase-(CT393) |
| CPn0501 | 582457 | 583650 | F | hrcA-HTH Transcriptional Repressor-(CT394) |
| CPn0502 | 583650 | 584201 | F | grpE-HSP-70 Cofactor-(CT395) |
| CPn0503 | 584234 | 586213 | F | dnaK-HSP-70-(CT396) |
| CPn0504 | 586487 | 588514 | F | vacB-ribonuclease family-(CT397) |
| CPn0505 | 588519 | 589106 | F | *3-methyladenine DNA glycosylase |
| CPn0506 | 589172 | 589840 | F | CT421 hypothetical protein |
| CPn0507 | 589961 | 590122 | F | CT421.1 hypothetical protein |
| CPn0508 | 590142 | 590300 | F | CT421.2 hypothetical protein |
| CPn0509 | 590335 | 590808 | F | (predicted Metalloenzyme)-(CT422) |
| CPn0510 | 590813 | 591973 | F | tlyC__2-CBS Domains (Hemolysin homolog)__2-(CT423) |
| CPn0511 | 592141 | 592488 | F | rsbV__1-Sigma Regulatory Factor__1-(CT424) |
| CPn0512 | 592553 | 594412 | F | CT425 hypothetical protein |
| CPn0513 | 594647 | 595753 | F | Fe—S oxidoreductase__1-(CT426) |
| CPn0514 | 595729 | 596520 | F | CT427 hypothetical protein |
| CPn0515 | 596492 | 597181 | F | ubiE-Ubiquinone Methyltransferase-(CT428) |
| CPn0516 | 598814 | 597255 | R | |
| CPn0517 | 599631 | 598795 | R | |
| CPn0518 | 600803 | 599832 | R | CT429 hypothetical protein |
| CPn0519 | 601674 | 600904 | R | dapF-Diaminopimelate Epimerase-(CT430) |
| CPn0520 | 602218 | 601646 | R | clpP-CLP Protease-(CT431) |
| CPn0521 | 603797 | 602241 | R | glyA-Serine Hydroxymethyltransferase-(CT432) |
| CPn0522 | 603987 | 604655 | F | CT433 hypothetical protein |
| CPn0523 | 604723 | 605052 | F | |
| CPn0524 | 605103 | 606179 | F | |
| CPn0525 | 606522 | 607283 | F | CT398 hypothetical protein |
| CPn0526 | 608696 | 607710 | R | yrbH-GutQ/KpsF Family Sugar-P Isomerase-(CT399) |
| CPn0527 | 609904 | 608726 | R | sucB__2-Dihydrolipoamide Succinyltransferase__2-(CT400) |
| CPn0528 | 611162 | 609921 | R | gltT-Glutamate Symport-(CT401) |
| CPn0529 | 612259 | 611165 | R | ycaH-ATPase-(CT402) |
| CPn0530 | 613254 | 612460 | R | spoU__1-rRNA Methylase__1-(CT403) |
| CPn0531 | 614069 | 613245 | R | SAM dependent methyltransferase-(CT404) |
| CPn0532 | 614674 | 614075 | R | ribC/risA-Riboflavin Synthase-(CT405) |
| CPn0533 | 614930 | 615385 | F | CT406 hypothetical protein |
| CPn0534 | 615413 | 615784 | F | dksA-DnaK Suppressor-(CT407) |
| CPn0535 | 615793 | 616296 | F | lspA-Lipoprotein Signal Peptidase-(CT408) |
| CPn0536 | 616345 | 617691 | F | dagA__1-D-Ala/Gly Permease__1-(CT409) |
| CPn0537 | 617833 | 618189 | F | CT814.1 hypothetical protein |
| CPn0538 | 618212 | 618511 | F | CT814 hypothetical protein |
| CPn0539 | 618705 | 621545 | F | pmp__19-polymorphic outer membrane protein A Family-(CT412) |
| CPn0540 | 621694 | 626862 | F | pmp__20-polymorphic outer membrane protein B Family-(CT413) |
| CPn0541 | 627170 | 628003 | F | Solute binding protein (-yebL-Synechocystis Adhesin Homolog)-(CT415) |
| CPn0542 | 628003 | 628737 | F | ABC Transporter ATPase-(CT416) |
| CPn0543 | 628725 | 629603 | F | (Metal Transport Protein)-(CT417) |
| CPn0544 | 630529 | 629525 | R | yhbZ-GTP binding protein-(CT418) |
| CPn0545 | 630884 | 630633 | R | rl27-L27 ribosomal protein-(CT419) |
| CPn0546 | 631229 | 630912 | R | rl21-L21 Robosomal Protein-(CT420) |
| CPn0547 | 631661 | 632188 | F | ygbB family-(CT434) |
| CPn0548 | 633231 | 632191 | R | cysJ-Sulfite Reductase-(CT435) |
| CPn0549 | 633569 | 633255 | R | rs10-S10 Ribosomal Protein-(CT436) |
| CPn0550 | 635661 | 633580 | R | fusA-Elongation Factor G-(CT437) |
| CPn0551 | 636168 | 635598 | R | rs7-S7 Ribosomal Protein-(CT438) |
| CPn0552 | 636587 | 636219 | R | rs12-S12 Ribosomal Protein (CT439) |
| CPn0553 | 637747 | 636812 | R | |
| CPn0554 | 637854 | 638141 | F | CT440 hypothetical protein |
| CPn0555 | 638298 | 640241 | F | tsp-Tail-Specific Protease-(CT441) |
| CPn0556 | 640912 | 640325 | R | crpA-15 kDa Cysteine-Rich Protein-(CT442) |
| CPn0557 | 642861 | 641194 | R | omcB-60 kDa Cysteine-Rich Outer Membrane Complex Protein-(CT443) |
| CPn0558 | 643300 | 643031 | R | omcA-9 kDa-Cysteine-Rich Outer Membrane Complex Lipoprotein-(CT444) |
| CPn0559 | 643742 | 643927 | F | CT441.1 hypothetical protein |
| CPn0560 | 645612 | 644098 | R | gltX-Glutamyl-tRNA Synthetase-(CT445) |
| CPn0561 | 646404 | 645871 | R | euo-CHLPS Euo Protein-(CT446) |
| CPn0562 | 648036 | 646918 | R | *CHLPS 43 kDa protein homolog__1 |
| CPn0563 | 650056 | 648293 | R | recJ-ssDNA Exonuclease-(CT447) |
| CPn0564 | 654350 | 650145 | R | secD&secF-Protein Export Proteins SecD/SecF (fusion)-(CT448) |
| CPn0565 | 655630 | 654533 | R | CT449 hypothetical protein |
| CPn0566 | 656141 | 656890 | F | yaeS family-(CT450) |
| CPn0567 | 656894 | 657817 | F | cdsA-Phosphatidate Cytidylyltransferase-(CT451) |

TABLE 2-continued

| Gene # | From | To | Strand | Gene Function (*C. Trachomatis* Ortholog in parenthesis) |
|---|---|---|---|---|
| CPn0568 | 657817 | 658464 | F | cdsA-Phosphatidate Cytidylytransferase-(CT452) |
| CPn0569 | 658464 | 659099 | F | plsC-Glycerol-3-P Acyltransferase-(CT453) |
| CPn0570 | 659107 | 660789 | F | argS-Arginyl tRNA Transferase-(CT454) |
| CPn0571 | 662122 | 660749 | R | murA-UDP-N-Acetylglucosamine Transferase-(CT455) |
| CPn0572 | 662352 | 664616 | F | CT456 hypothetical protein |
| CPn0573 | 665404 | 664691 | R | yebC family-(CT457) |
| CPn0574 | 665945 | 665394 | R |  |
| CPn0575 | 666494 | 665982 | R | YhhY-Amino Group Acetyl Transferase-(CT458) |
| CPn0576 | 667543 | 666494 | R | prfB-Peptide Chain Release Factor 2 (natural UGA frame-shift)-(CT455) |
| CPn0576 | 667598 | 667530 | R | prfB-(natural UGA frame-shift) |
| CPn0577 | 667895 | 668155 | F | SWIB (YM74) complex protein-(CT460) |
| CPn0578 | 668406 | 669365 | F | yaeI-phosphohydrolase-(CT461) |
| CPn0579 | 669361 | 669993 | F | ygbP/yacM-Sugar Nucleotide Phosphorylase-(CT462) |
| CPn0580 | 669993 | 670793 | F | truA-Pseudouridylate Synthase I-(CT463) |
| CPn0581 | 671434 | 670745 | R | Phosphoglycolate Phosphatase-(CT464) |
| CPn0582 | 671503 | 672177 | F | CT465 hypothetical protein |
| CPn0583 | 672400 | 672717 | F | CT466 hypothetical protein |
| CPn0584 | 672707 | 673798 | F | atoS/ntrB-2-Component Sensor-(CT467) |
| CPn0585 | 675817 | 673865 | R | *similarity to Cps IncA_2 |
| CPn0586 | 676026 | 677183 | F | atoC/ntrC-2-Component Regulator-(CT468) |
| CPn0587 | 677441 | 678124 | F | *yvyD_Bs conserved hypothetical protein |
| CPn0588 | 678084 | 678626 | F | CT469 hypothetical protein |
| CPn0589 | 678640 | 679395 | F | CT470 hypothetical protein |
| CPn0590 | 680112 | 679516 | F | CT471 hypothetical protein |
| CPn0591 | 680373 | 681020 | F | yagE family-(CT472) |
| CPn0592 | 681153 | 681461 | R | yidD family-(CT473) |
| CPn0593 | 682476 | 681391 | R | CT474 hypothetical protein |
| CPn0594 | 682583 | 684958 | F | pheT-phenylalanyl tRNA Synthetase Beta-(CT475) |
| CPn0595 | 684958 | 685926 | R | CT476 hypothetical protein |
| CPn0596 | 685939 | 686457 | F | ada-methyltransferase-(CT477) |
| CPn0597 | 688215 | 686479 | R | oppC_2-Oligopeptide Permease_2-(CT478) |
| CPn0598 | 689697 | 688219 | R | oppB_2-Oligopeptide Permease_2-(CT479) |
| CPn0599 | 691802 | 689682 | R | oppA_5-oligopeptide Binding Lipoprotein_5-(CT480) |
| CPn0600 | 692147 | 691827 | R |  |
| CPn0601 | 693053 | 692736 | R | CT483 hypothetical protein |
| CPn0602 | 694105 | 693104 | R | CT484 hypothetical protein |
| CPn0603 | 694205 | 695185 | F | hemZ-Ferrochetalase-(CT485) |
| CPn0604 | 695945 | 695196 | R | fliY-Glutamine Binding Protein-(CT486) |
| CPn0605 | 696707 | 696150 | R | yhhF-Methylase-(CT487) |
| CPn0606 | 697444 | 696707 | R | CT488 hypothetical protein |
| CPn0607 | 698895 | 697573 | R | glgC-Glucose-1-P Adenyltransferase-(CT489) |
| CPn0608 | 699645 | 699016 | R | *pyrF-Uridine 5'-Monophosphate Synthase (Ump Synthase)-truncated? |
| CPn0609 | 699705 | 699986 | F | CT490 hypothetical protein |
| CPn0610 | 701420 | 700029 | R | rho-Transcription Termination Factor-(CT491) |
| CPn0611 | 702025 | 701420 | R | yacE-predicted phosphatase/kinase-(CT492) |
| CPn0612 | 704631 | 702022 | R | polA-DNA Polymerase I-(CT493) |
| CPn0613 | 705656 | 704658 | R | sohB-Protease-(CT494) |
| CPn0614 | 707402 | 705783 | R | adt_2-ADP/ATP Translocase_2-(CT495) |
| CPn0615 | 708137 | 707634 | R | pgsA_1-Glycerol-3-P Phosphatidyltransferase_1-(CT496) |
| CPn0616 | 708791 | 710137 | F | dnaB-Replicative DNA Helicase-(CT497) |
| CPn0617 | 710484 | 712316 | F | gidA-FAD-dependent oxidoreductase-(CT498) |
| CPn0618 | 712306 | 713010 | F | lplA-Lipoate-Protein Ligase A-(CT499) |
| CPn0619 | 713444 | 713013 | R | ndk-Nucleoside-2-P Kinase-(CT500) |
| CPn0620 | 714139 | 713519 | R | ruvA-Holliday Junction Helicase-(CT501) |
| CPn0621 | 714647 | 714144 | R | ruvC-Crossover Junction Endonuclease-(CT502) |
| CPn0622 | 715752 | 714793 | R | CT503 hypothetical protein |
| CPn0623 | 716993 | 716163 | R | CT504 hypothetical protein |
| CPn0624 | 718015 | 717011 | R | gapA-Glyceraldehyde-3-P Dehydrogenase-(CT505) |
| CPn0625 | 718485 | 718060 | R | rl17-L17 Ribosomal Protein-(CT506) |
| CPn0626 | 719616 | 718495 | R | rpoA-RNA Polymerase Alpha-(CT507) |
| CPn0627 | 720038 | 719640 | R | rs11-S11 Ribosomal Protein-(CT508) |
| CPn0628 | 720428 | 720063 | R | rs13-S13 Ribosomal Protein-(CT509) |
| CPn0629 | 721857 | 720487 | R | secY-Translocase-(CT510) |
| CPn0630 | 722316 | 721885 | R | rl15-L15 Ribosomal Protein-(CT511) |
| CPn0631 | 722806 | 722312 | R | rs5-S5 Ribosomal Protein-(CT512) |
| CPn0632 | 723195 | 722827 | R | rl18-L18 Ribosomal Protein-(CT513) |
| CPn0633 | 723757 | 723209 | R | rl6-L6 Ribosomal Protein-(CT514) |
| CPn0634 | 724185 | 723787 | R | rs8-S8 Ribosomal Protein-(CT515) |
| CPn0635 | 724745 | 724206 | R | rl5-L5 Ribosomal Protein-(CT516) |
| CPn0636 | 725082 | 724750 | R | rl24-L24 Ribosomal Protein-(CT517) |
| CPn0637 | 725464 | 725099 | R | rl14-L14 Ribosomal Protein-(CT518) |
| CPn0638 | 725747 | 725490 | R | rs17-S17 Ribosomal Protein-(CT519) |
| CPn0639 | 725958 | 725743 | R | rl29-L29 Ribosomal Protein-(CT520) |
| CPn0640 | 726377 | 725964 | R | rl16-L16 Ribosomal Protein-(CT521) |
| CPn0641 | 727077 | 726409 | R | rs3-S3 Ribosomal Protein-(CT522) |
| CPn0642 | 727428 | 727096 | R | rl22-L22 Ribosomal Protein-(CT523) |
| CPn0643 | 727713 | 727450 | R | rs19-S19 Ribosomal Protein-(CT524) |

TABLE 2-continued

| Gene # | From | To | Strand | Gene Function (*C. Trachomatis* Ortholog in parenthesis) |
|---|---|---|---|---|
| CPn0644 | 728573 | 727722 | R | rl2-L2 Ribosomal Protein-(CT525) |
| CPn0645 | 728930 | 728598 | R | rl23-L23 Ribosomal Protein-(CT526) |
| CPn0646 | 729621 | 728950 | R | rl4-L4 Ribosomal Protein-(CT527) |
| CPn0647 | 730331 | 729657 | R | rl3-L3 Ribosomal Protein-(CT528) |
| CPn0648 | 731603 | 730605 | R | CT529 hypothetical protein |
| CPn0649 | 732672 | 731710 | R | fmt-Methionyl tRNA Formyltransferase-(CT530) |
| CPn0650 | 733501 | 732665 | R | lpxA-Acyl-Carrier UDP-GlcNAc-(CT531) |
| CPn0651 | 733975 | 733517 | R | fabZ-Myristoyl-Acyl Carrier Dehydratase-(CT532) |
| CPn0652 | 734835 | 733990 | R | lpxC-Myristoyl GlcNac Deacetylase-(CT533) |
| CPn0653 | 736490 | 734868 | R | cutE-Apolipoprotein N-Acetyltransferase-(CT534) |
| CPn0654 | 736967 | 736503 | R | vdlD/yciA-acyl-CoA Thioesterase-(CT535) |
| CPn0655 | 737847 | 737101 | R | dnaQ_2-DNA Pol III Epsilon Chain_2-(CT536) |
| CPn0656 | 737872 | 738048 | F | |
| CPn0657 | 738473 | 738051 | R | yjeE (ATPase or Kinase)-(CT537) |
| CPn0658 | 739168 | 738455 | R | CT538 hypothetical protein |
| CPn0659 | 739533 | 739838 | F | trxA-Thioredoxin-(CT539) |
| CPn0660 | 740327 | 739860 | R | spoU_2-rRNA Methylase_2-(CT540) |
| CPn0661 | 741100 | 740327 | R | mip-FKBP-type peptidyl-prolyl cis-trans isomerase-(CT541) |
| CPn0662 | 742923 | 741172 | R | aspS-Aspartyl tRNA Synthetase-(CT542) |
| CPn0663 | 744190 | 742901 | R | hisS-Histidyl tRNA Synthetase-(CT543) |
| CPn0664 | 744757 | 744557 | R | |
| CPn0665 | 745001 | 746365 | F | uhpC-Hexosphosphate Transport-(CT544) |
| CPn0666 | 746388 | 750107 | F | dnaE-DNA Pol III Alpha-(CT545) |
| CPn0667 | 751058 | 750177 | R | predicted OMP (leader (17)-(CT546) |
| CPn0668 | 751209 | 752162 | F | CT547 hypothetical protein |
| CPn0669 | 752179 | 752775 | F | CT548 hypothetical protein |
| CPn0670 | 752765 | 753196 | F | rsbW-sigma regulatory factor-histidine kinase-(CT549) |
| CPn0671 | 753630 | 753205 | R | CT550 hypothetical protein |
| CPn0672 | 753741 | 755048 | F | dacF(pbpS)-D-Ala-D-Ala Caroxypeptidase-(CT551) |
| CPn0673 | 755287 | 755463 | F | CT552 hypothetical protein |
| CPn0674 | 756668 | 755577 | R | fmu-RNA Methyltransferase-(CT553) |
| CPn0675 | 757919 | 756768 | R | CT696 hypothetical protein |
| CPn0676 | 759217 | 758051 | R | homologous to CT695 |
| CPn0677 | 760401 | 759256 | R | |
| CPn0678 | 761320 | 760682 | R | |
| CPn0679 | 762930 | 761725 | R | pgk-Phosphoglycerate Kinase-(CT693) |
| CPn0680 | 764248 | 762971 | R | ygo4-Phosphate Permease-(CT692) |
| CPn0681 | 764929 | 764258 | R | CT691 hypothetical protein |
| CPn0682 | 764984 | 765955 | F | dppD-ABC ATPase Dipeptide Transport-(CT690) |
| CPn0683 | 765948 | 766919 | F | dppF-ABC ATPase Dipeptide Transport-(CT689) |
| CPn0684 | 768038 | 767181 | R | spoJ/parB-Chromosome Partitioning Protein-(CT688) |
| CPn0685 | 768068 | 768217 | F | |
| CPn0686 | 768361 | 768176 | R | |
| CPn0687 | 768564 | 769214 | F | CT482 hypothetical protein |
| CPn0688 | 769382 | 770137 | F | CT481 hypothetical protein |
| CPn0689 | 771404 | 770187 | R | yfhO_1-NifS-related Aminotransferase_1-(CT687) |
| CPn0690 | 772680 | 771436 | R | ABC Transporter Membrane Protein-(CT686) |
| CPn0691 | 773452 | 772685 | R | abcX-ABC Transporter ATPase-(CT685) |
| CPn0692 | 774912 | 773461 | R | ABC Transporter-(CT684) |
| CPn0693 | 776256 | 775240 | R | TPR Repeats (O-Linked GlcNAc Transferase similarity)-(CT683) |
| CPn0694 | 779599 | 776330 | R | pbp2-PBP2-transglycolase/transpeptidase-(CT682) |
| CPn0695 | 780216 | 781382 | F | ompA-Major Outer Membrane Protein-(CT681) |
| CPn0696 | 781769 | 782599 | F | rs2-S2 Ribosomal Protein-(CT680) |
| CPn0697 | 782602 | 783447 | F | tsf-Elongation Factor T5-(CT679) |
| CPn0698 | 783458 | 784201 | F | pyrH-UMP Kinase-(CT679) |
| CPn0699 | 784182 | 784721 | F | rrf-Ribosome Releasing Factor-(CT677) |
| CPn0700 | 785097 | 785609 | F | CT676 hypothetical protein |
| CPn0701 | 785599 | 786672 | F | karG-Arginine Kinase-(CT675) |
| CPn0702 | 789685 | 786929 | R | yscC/gspD-Yop C/Gen Secretion Protein D-(CT674) |
| CPn0703 | 791190 | 789685 | R | pkn5-S/T Protein Kinase-(CT673) |
| CPn0704 | 792321 | 791209 | R | fliN-Flagellar Motor Switch Domain/YacQ family-(CT672) |
| CPn0705 | 793173 | 792334 | R | CT671 hypothetical protein |
| CPn0706 | 793683 | 793180 | R | CT670 hypothetical protein |
| CPn0707 | 795029 | 793704 | R | yscN-Yop N (Flagellar-Type ATPase)-(CT669) |
| CPn0708 | 795705 | 795034 | R | CT668 hypothetical protein |
| CPn0709 | 796188 | 795742 | R | CT667 hypothetical protein |
| CPn0710 | 796461 | 796210 | R | CT666 hypothetical protein |
| CPn0711 | 796731 | 796486 | R | CT665 hypothetical protein |
| CPn0712 | 799315 | 796781 | R | FHA domain: homology to adenylate cyclase)-(CT664) |
| CPn0713 | 799721 | 799332 | R | CT663 hypothetical protein |
| CPn0714 | 801107 | 800091 | R | hemA-Glutamyl tRNA Reductase-(CT662) |
| CPn0715 | 801657 | 803462 | F | gyrB_2-DNA Gyrase Subunit B_2-(CT661) |
| CPn0716 | 803469 | 804902 | F | gyrA_2-DNA Gyrase Subunit A_2-(CT660) |
| CPn0717 | 805010 | 805306 | F | CT656 hypothetical protein |
| CPn0718 | 805309 | 805626 | F | CT657 hypothetical protein |
| CPn0719 | 805916 | 806890 | F | sfhB-(Pseudouridine Synthase)-(CT658) |
| CPn0720 | 807003 | 807236 | F | CT659 hypothetical protein |

TABLE 2-continued

| Gene # | From | To | Strand | Gene Function (C. Trachomatis Ortholog in parenthesis) |
|---|---|---|---|---|
| CPn0721 | 807683 | 808489 | F | kdsA-KDO Synthetase-(CT655) |
| CPn0722 | 808489 | 808974 | F | CT654 hypothetical protein |
| CPn0723 | 808984 | 809703 | F | yhbG-ABC Transporter ATPase-(CT653) |
| CPn0724 | 810527 | 809706 | R | |
| CPn0725 | 810811 | 810587 | R | CT652.1 hypothetical protein |
| CPn0726 | 813372 | 810880 | R | CT620 hypothetical protein |
| CPn0727 | 813577 | 816192 | F | CT619 hypothetical protein |
| CPn0728 | 818477 | 816525 | R | CHLPN 76 kDa Homolog_1 (CT622) |
| CPn0729 | 819857 | 818592 | R | CHLPN 76 kDa Homolog_2 (CT623) |
| CPn0730 | 821603 | 819963 | R | mviN-Integral Membrane Protein-(CT624) |
| CPn0731 | 821587 | 821760 | F | |
| CPn0732 | 822098 | 822976 | F | nfo-Endonuclease IV-(CT625) |
| CPn0733 | 823727 | 823101 | R | rs4-S4 Ribosomal Protein-(CT626) |
| CPn0734 | 823944 | 824915 | F | yceA-(CT627) |
| CPn0735 | 825668 | 825003 | R | *pyrH/udk-Uridine Kinase (Uridine Monophosphokinase) (Pyrimidine Ribonucleoside Kinase) |
| CPn0736 | 827686 | 825992 | R | ygeD-Efflux Protein-(CT641) |
| CPn0737 | 827685 | 830756 | F | recC-Exodeoxyribonuclease V, Gamma-(CT640) |
| CPn0738 | 830746 | 833895 | F | recB-Exodeoxyribonuclease V, Beta-(CT639) |
| CPn0739 | 834871 | 833861 | R | CT638 hypothetical protein |
| CPn0740 | 836048 | 834864 | R | tyrB-Aromatic AA Aminotransferase-(CT637) |
| CPn0741 | 838350 | 836185 | R | greA-Transcription Elongation Factor-(CT636) |
| CPn0742 | 838463 | 838888 | F | CT635 hypothetical protein |
| CPn0743 | 838962 | 840362 | F | nqrA-Ubiquinone Oxidoreductase, Alpha-(CT634) |
| CPn0744 | 841384 | 840389 | R | hemB-Porphobilinogen Synthase-(CT633) |
| CPn0745 | 841903 | 841742 | R | |
| CPn0746 | 841975 | 843567 | F | CT632 hypothetical protein |
| CPn0747 | 843675 | 843740 | F | CT631 hypothetical protein |
| CPn0747 | 843725 | 843910 | F | CT631 hypothetical protein (frame-shift) |
| CPn0748 | 844987 | 844121 | R | ispA-Geranyl Transtransferase-(CT628) |
| CPn0749 | 845629 | 845006 | R | glmU-UDP-GlcNAc Pyrophosphorylase-(CT629) |
| CPn0750 | 846411 | 845707 | R | tctD/cpxR-HTH Transcriptional Regulatory Protein + Receiver Doman-(CT630) |
| CPn0751 | 846608 | 848434 | F | CT651 hypothetical protein |
| CPn0752 | 848604 | 850082 | F | recD_2-Exodeoxyribonuclease V, Alpha_2-(CT652) |
| CPn0753 | 851006 | 850161 | R | |
| CPn0754 | 851336 | 851040 | R | rs20-S20 Ribosomal Protein-(CT617) |
| CPn0755 | 851597 | 852799 | F | CT616 hypothetical protein |
| CPn0756 | 852961 | 854676 | F | rpoD-RNA Polymerase Sigma-66-(CT615) |
| CPn0757 | 854733 | 855134 | F | folX-Dihydroneopterin Aldolase-(CT614) |
| CPn0758 | 855110 | 856459 | F | folP/dhpS-Dihydropteroate Synthase-(CT613) |
| CPn0759 | 856488 | 856997 | F | folA-Dihydrofolate Reductase-(CT612) |
| CPn0760 | 856957 | 857694 | F | CT611 hypothetical protein |
| CPn0761 | 857704 | 858375 | F | CT610 hypothetical protein |
| CPn0762 | 859597 | 858539 | R | recA-RecA recombination protein-(CT650) |
| CPn0763 | 860511 | 859972 | R | ygfA-Formyltetrahydrofolate Cycloligase-(CT649) |
| CPn0764 | 861807 | 860524 | R | CT648 hypothetical protein |
| CPn0765 | 862382 | 861801 | R | CT647 hypothetical protein |
| CPn0766 | 863782 | 862394 | R | CT646 hypothetical protein |
| CPn0767 | 863884 | 864177 | F | CT645 hypothetical protein |
| CPn0768 | 864159 | 865163 | F | yohI/nir3-predicted oxidoreductase-(CT644) |
| CPn0769 | 867733 | 865121 | R | topA-DNA Topoisomerase I-Fused to SWI Domain-(CT643) |
| CPn0770 | 868340 | 869131 | F | CT642 hypothetical protein |
| CPn0771 | 870463 | 869144 | R | rpoN-RNA Polymerase Sigma-54-(CT609) |
| CPn0772 | 872385 | 870469 | R | uvrD-DNA Helicase-(CT608) |
| CPn0773 | 872488 | 873195 | F | ung-Uracil DNA Glycosylase-(CT607) |
| CPn0774 | 873195 | 873425 | F | CT606.1 hypothetical protein |
| CPn0775 | 874031 | 873414 | R | yggV family-(CT606) |
| CPn0776 | 874246 | 875487 | F | CT605 hypothetical protein |
| CPn0777 | 875601 | 877178 | F | groEL_2-heat shock protein-60-(CT604) |
| CPn0778 | 877505 | 878092 | F | tsa/ahpC-Thio-specific Antioxidant (TSA) Peroxidase-(CT603) |
| CPn0779 | 878481 | 878095 | R | CT602 hypothetical protein |
| CPn0780 | 879205 | 878591 | R | papQ/amiB-N-Acetylmuramoyl-L-Ala Amidase-(CT601) |
| CPn0781 | 879773 | 879198 | R | pal-Peptidoglycan-Associated Lipoprotein-(CT600) |
| CPn0782 | 881065 | 879773 | R | tolB-polysaccharide transporter-(CT599) |
| CPn0783 | 881885 | 881100 | R | CT598 hypothetical protein |
| CPn0784 | 882296 | 881892 | R | exbD-Biopolymer Transport Protein-(CT597) |
| CPn0785 | 882991 | 882296 | R | exbB/tolQ-polysaccharide transporter-(CT596) |
| CPn0786 | 883185 | 885293 | F | dsbD/xprA-Thio:disulfide Interchange Protein-(CT595) |
| CPn0787 | 885619 | 886401 | F | yabD/ycfH-PHP superfamily (urease/pyrimidinase) hydrolase-(CT594) |
| CPn0788 | 886542 | 887432 | F | sdhC-Succinate Dehydrogenase-(CT593) |
| CPn0789 | 887439 | 889316 | F | sdhA-Succinate Dehydrogenase-(CT592) |
| CPn0790 | 889330 | 890103 | F | sdhB-Succinate Dehydrogenase-(CT591) |
| CPn0791 | 893050 | 890111 | R | CT590 hypothetical protein |
| CPn0792 | 894919 | 893108 | R | CT589 hypothetical protein |
| CPn0793 | 896823 | 894919 | R | rbsU-sigma regulatory family protein-PP2C phosphatase (RsbW antagonist)-(CT588) |
| CPn0794 | 897174 | 898004 | F | |

TABLE 2-continued

| Gene # | From | To | Strand | Gene Function (*C. Trachomatis* Ortholog in parenthesis) |
|---|---|---|---|---|
| CPn0795 | 898128 | 899195 | F | |
| CPn0796 | 899301 | 901340 | F | |
| CPn0797 | 901600 | 902694 | F | |
| CPn0798 | 902846 | 903856 | F | |
| CPn0799 | 904986 | 903940 | R | |
| CPn0800 | 906532 | 905249 | R | eno-Enolase-(CT587) |
| CPn0801 | 908697 | 906727 | R | uvrB-Exinuclease ABC Subunit B-(CT586) |
| CPn0802 | 909740 | 908709 | R | trpS-Tryptophanyl tRNA Synthetase-(CT585) |
| CPn0803 | 910303 | 909752 | R | CT584 hypothetical protein |
| CPn0804 | 911059 | 910310 | R | gp6D-CHLTR Plasmid Paralog-(CT583) |
| CPn0805 | 911831 | 911067 | R | minD-chromosome partitioning ATPase-CHLTR plasmid protein GP5D-(CT582) |
| CPn0806 | 913771 | 911867 | R | thrS-Threonyl tRNA Synthetase-(CT581) |
| CPn0807 | 913971 | 914879 | F | CT580 hypothetical protein |
| CPn0808 | 916287 | 914956 | R | CT579 hypothetical protein |
| CPn0809 | 917785 | 916307 | R | CT578 hypothetical protein |
| CPn0810 | 918184 | 917825 | R | CT577 hypothetical protein |
| CPn0811 | 918900 | 918208 | R | lcrH_1-Low Ca Response Protein H_1-(CT576) |
| CPn0812 | 919123 | 920862 | F | mutL-DNA Mismatch Repair-(CT575) |
| CPn0813 | 920870 | 921934 | F | pepP-Aminopeptidase P-(CT574) |
| CPn0814 | 922107 | 923357 | F | CT573 hypothetical protein |
| CPn0815 | 923361 | 925622 | F | gspD/pilQ-Gen. Secretion Protein D-(CT572) |
| CPn0816 | 925615 | 927102 | F | gspE-Gen. Secretion Protein E-(CT571) |
| CPn0817 | 927115 | 928287 | F | gspF-Gen. Secretion Protein F-(CT570) |
| CPn0818 | 928314 | 928682 | F | predicted QMP [leader (16) peptide]-(CT569) |
| CPn0819 | 928689 | 929132 | F | CT568 hypothetical protein |
| CPn0820 | 929120 | 929659 | F | CT567 hypothetical protein |
| CPn0821 | 929667 | 930668 | F | CT566 hypothetical protein |
| CPn0822 | 930756 | 931229 | F | CT565 hypothetical protein |
| CPn0823 | 932367 | 931501 | R | yscT/spaR-YopT Translocation T-(CT564) |
| CPn0824 | 932662 | 932378 | R | yscS/fliQ-YopS/fliQ Translocation Protein-(CT563) |
| CPn0825 | 933594 | 932677 | R | yscR-Yop Translocation R-(CT562) |
| CPn0826 | 934310 | 933612 | R | yscL-Yop Translocation L-(CT561) |
| CPn0827 | 935264 | 934434 | R | CT560 hypothetical protein |
| CPn0828 | 936271 | 935267 | R | yscJ-Yop Translocation J-(CT559) |
| CPn0829 | 936744 | 937298 | F | |
| CPn0830 | 937444 | 937959 | F | |
| CPn0831 | 938267 | 938434 | F | |
| CPn0832 | 939747 | 938827 | R | lipA-Lipoate Synthetase-(CT558) |
| CPn0833 | 941129 | 939747 | R | lpdA-Lipoamide Dehydrogenase-(CT557) |
| CPn0834 | 941553 | 942014 | F | CT556 hypothetical protein |
| CPn0835 | 945689 | 942045 | R | mot1_1-SWI/SNF family helicase_1-(CT555) |
| CPn0836 | 946879 | 945722 | R | brnQ-Amino Acid (Branched) Transport-(CT554) |
| CPn0837 | 947771 | 947145 | R | nth-Enodnuclease III-(CT697) |
| CPn0838 | 949106 | 947781 | R | thdF-Thiophene/Furan Oxidation Protein-(CT698) |
| CPn0839 | 949257 | 950159 | F | psdD-Phosphatidylserine Decarboxylase-(CT699) |
| CPn0840 | 950222 | 951544 | F | CT700 hypothetical protein |
| CPn0841 | 951731 | 954640 | F | secA_2-Translocase SecA_2-(CT701) |
| CPn0842 | 954883 | 954710 | R | CT702 hypothetical protein (frame-shift with 0843) |
| CPn0843 | 955191 | 954994 | R | CT702 hypothetical protein |
| CPn0844 | 956730 | 955270 | R | yphC-GTPase/GTP-binding protein-(CT703) |
| CPn0845 | 958079 | 956850 | R | pcnB_1-Poly A Polymerase_1-(CT704) |
| CPn0846 | 959374 | 958112 | R | clpX-CLP Protease ATPase-(CT705) |
| CPn0847 | 959995 | 959387 | R | clpP-CLP Protease Subunit-(CT706) |
| CPn0848 | 961502 | 960177 | R | tig/murI-Trigger Factor-peptidyl-prolyl isomerase-(CT707) |
| CPn0849 | 961788 | 965285 | F | mot1_2-SWI/SNF family helicase_2-(CT708) |
| CPn0850 | 965293 | 966390 | F | mreB-Rod Shape Protein-Sugar Kinase-(CT709) |
| CPn0851 | 966396 | 968195 | F | pckA-Phosphoenolpyruvate Carboxykinase-(CT710) |
| CPn0852 | 968316 | 970613 | F | CT711 hypothetical protein |
| CPn0853 | 970637 | 971803 | F | CT712 hypothetical protein |
| CPn0854 | 972837 | 971806 | R | ompB-Outer Membrane Protein B-(CT713) |
| CPn0855 | 973995 | 972994 | R | gpdA-Glycerol-3-P Dehydrogenase-(CT714) |
| CPn0856 | 975377 | 973995 | R | AgX-1 Homolog-UDP-Glucose Pyrophosphorylase-(CT715) |
| CPn0857 | 975757 | 975392 | R | CT716 hypothetical protein |
| CPn0858 | 977055 | 975757 | R | fliI-Flagellum-specific ATP Synthase-(CT717) |
| CPn0859 | 977588 | 977055 | R | CT718 hypothetical protein |
| CPn0860 | 978630 | 977608 | R | fliF-Flagellar M-Ring Protein-(CT719) |
| CPn0861 | 979722 | 978925 | R | nifU-NifU-related protein-(CT720) |
| CPn0862 | 980873 | 979722 | R | yfhO_2-NifS-related protein_2-(CT721) |
| CPn0863 | 981514 | 980831 | R | pgmA-Phosphoglycerate Mutase-(CT722) |
| CPn0864 | 981670 | 982374 | F | yjbC-predicted pseudouridine synthase-(CT723) |
| CPn0865 | 982418 | 982942 | F | CT724 hypothetical protein |
| CPn0866 | 983491 | 982916 | R | birA-Biotin Synthetase-(CT725) |
| CPn0867 | 983423 | 984667 | F | rodA-Rod Shape Protein-(CT726) |
| CPn0868 | 986643 | 984670 | R | zntA/cadA-Metal Transport P-type ATPase-(CT727) |
| CPn0869 | 987401 | 986658 | R | CT728 hypothetical protein |
| CPn0870 | 988728 | 987448 | R | serS-Seryl tRNA Synthetase_2-(CT729) |
| CPn0871 | 988772 | 989899 | F | ribD-Riboflavin Deaminase-(CT730) |

TABLE 2-continued

| Gene # | From | To | Strand | Gene Function (*C. Trachomatis* Ortholog in parenthesis) |
|---|---|---|---|---|
| CPn0872 | 989963 | 991216 | F | ribA&ribB-GTP Cyclohydratase & DHBP Synthase-(CT731) |
| CPn0873 | 991233 | 991694 | F | ribE-Ribityllumazine Synthase-(CT732) |
| CPn0874 | 993107 | 991749 | F | CT733 hypothetical protein |
| CPn0875 | 993372 | 994022 | F | CT734 hypothetical protein |
| CPn0876 | 994144 | 995517 | F | dagA_2-D-Alanine/Glycine Permease_2-(CT735) |
| CPn0877 | 995533 | 995982 | F | ybcL family-(CT736) |
| CPn0878 | 996654 | 995992 | F | SET Domain protein-(CT737) |
| CPn0879 | 997439 | 996645 | R | yycJ-metal dependent hydrolase-(CT738) |
| CPn0880 | 999861 | 997444 | R | ftsK-Cell Division Protein FtsK-(CT739) |
| CPn0881 | 1005667 | 1006209 | F | |
| CPn0882 | 1006268 | 1007404 | F | |
| CPn0883 | 1008865 | 1007573 | R | dmpP/nqr6-Phenolhydrolase/NADH ubiquinone oxidoreductase-(CT740) |
| CPn0884 | 1009359 | 1009009 | R | CT741 hypothetical protein |
| CPn0885 | 1010635 | 1009433 | R | ygcA-rRNA Methyltransferse-(CT742) |
| CPn0886 | 1011276 | 1010908 | R | hctA-Histone-Like Developmental Protein-(CT743) |
| CPn0887 | 1011692 | 1014157 | F | CHLTR possible phosphoprotein-(CT744) |
| CPn0888 | 1015423 | 1014119 | R | hemG-protoporphyrinogen Oxidase-(CT745) |
| CPn0889 | 1016835 | 1015462 | R | hemN_2-Coproporphyrinogen III Oxidase_2-(CT746) |
| CPn0890 | 1017805 | 1016819 | R | hemE-Uroporphyrinogen Decarboxylase-(CT747) |
| CPn0891 | 1021073 | 1017819 | R | mfd-Transcription-Repair Coupling-(CT748) |
| CPn0892 | 1023661 | 1021046 | R | alaS-Alanyl tRNA Synthetase-(CT749) |
| CPn0893 | 1023894 | 1025888 | F | tktB-Transketolase-(CT750) |
| CPn0894 | 1026766 | 1025888 | R | amn-AMP Nucleosidase-(CT751) |
| CPn0895 | 1026988 | 1027557 | F | efp_2-Elongation Factor P_2-(CT752) |
| CPn0896 | 1027595 | 1027822 | F | CT753 hypothetical protein |
| CPn0897 | 1028737 | 1027853 | R | (possible phosphohydrolase)-(CT754) |
| CPn0898 | 1030460 | 1028904 | R | Mitochondrial HSP60 Chaperonin Homolog-(CT755) |
| CPn0899 | 1030875 | 1032215 | F | murF-Muramoyl-DAP Ligase-(CT756) |
| CPn0900 | 1032235 | 1033281 | F | mraY-Muramoyl-Pentapeptide Transferase-(CT757) |
| CPn0901 | 1033287 | 1034537 | F | murD-Muramoylalanine-Glutamate Ligase-(CT758) |
| CPn0902 | 1034543 | 1035241 | F | nlpD-Muramidase (invasin repeat family)-(CT759) |
| CPn0903 | 1035263 | 1036417 | F | ftsW-Cell Division Protein FtsW-(CT760) |
| CPn0904 | 1036326 | 1037396 | F | murG-Peptidoglycan Transferase-(CT761) |
| CPn0905 | 1037409 | 1039835 | F | murC&ddlA-Muramate-Ala Ligase & D-Ala-D-Alam Ligase-(CT762) |
| CPn0906 | 1040340 | 1039915 | R | CT763 hypothetical protein |
| CPn0907 | 1040780 | 1040445 | R | *cutA Periplasmic Divalent Cation Tolerance Protein CutA (C-Type Cytochrome Biogenesis Protein) |
| CPn0908 | 1041589 | 1040780 | R | CT764 hypothetical protein |
| CPn0909 | 1041637 | 1041966 | F | rsbV_2-Sigma Factor Regulator_2-(CT765) |
| CPn0910 | 1041979 | 1043004 | F | miaA-tRNA Pyrophosphate Transferase-(CT766) |
| CPn0911 | 1044043 | 1042985 | R | Fe—S cluster oxidoreductase_2-(CT767) |
| CPn0912 | 1044129 | 1045760 | F | CT768 hypothetical protein |
| CPn0913 | 1045760 | 1045945 | F | |
| CPn0914 | 1045999 | 1046397 | F | |
| CPn0915 | 1046461 | 1046817 | F | ybeB-iojap superfamily ortholog-(CT769) |
| CPn0916 | 1046837 | 1048084 | F | fabF-Acyl Carrier Protein Synthase-(CT770) |
| CPn0917 | 1048090 | 1048539 | F | hydrolase/phosphatase homolog-(CT771) |
| CPn0918 | 1049223 | 1048579 | R | ppa-Inorganic Pyrophosphatase-(CT772) |
| CPn0919 | 1049378 | 1050430 | F | ldh-Leucine Dehydrogenase-(CT773) |
| CPn0920 | 1051405 | 1050431 | R | cysQ-Sulfite Synthesis/biphosphate phosphatase-(CT774) |
| CPn0921 | 1051535 | 1052293 | F | snGlycerol-3-P Acyltransferase-(CT775) |
| CPn0922 | 1052314 | 1053927 | F | aas-Acylglycerophosphoethanolamine Acyltransferase-(CT776) |
| CPn0923 | 1053984 | 1055093 | F | bioF_1-Oxononanoate Synthase_1-(CT777) |
| CPn0924 | 1057274 | 1055028 | R | priA-Primosomal Protein N'-(CT778) |
| CPn0925 | 1057900 | 1057226 | R | CT779 hypothetical protein |
| CPn0926 | 1058060 | 1058557 | F | Thioredoxin Disulfide Isomerase-(CT780) |
| CPn0927 | 1059809 | 1058670 | R | *CHLPS 43 kDa protein homolog_2 |
| CPn0928 | 1061008 | 1059884 | R | *CHLPS 43 kDa protein homolog_3 |
| CPn0929 | 1062292 | 1061186 | R | *CHLPS 43 kDa protein homolog_4 |
| CPn0930 | 1062857 | 1063330 | F | |
| CPn0931 | 1064138 | 1065718 | F | lysS-Lysyl tRNA Synthetase-(CT781) |
| CPn0932 | 1067142 | 1065721 | R | cysS-Cysteinyl tRNA Synthetase-(CT782) |
| CPn0933 | 1067535 | 1068578 | F | predicted disulfide bond isomerase-(CT783) |
| CPn0934 | 1068942 | 1068526 | R | rnpA-Ribonuclease P Protein Component-(CT784) |
| CPn0935 | 1069091 | 1068957 | R | rl34-L34 Ribosomal Protein-(CT785) |
| CPn0936 | 1069336 | 1069470 | F | rl36-L36 Ribosomal Protein-(CT786) |
| CPn0937 | 1069496 | 1069798 | F | rs14-S14 Ribosomal Protein-(CT787) |
| CPn0938 | 1070322 | 1069849 | R | CT788 hypothetical protein-(leader (60) peptide-periplasmic) |
| CPn0939 | 1070728 | 1071195 | F | CT790 hypothetical protein |
| CPn0940 | 1073012 | 1071204 | R | uvrC-Excinuclease ABC, Subunit C-(CT791) |
| CPn0941 | 1075501 | 1073018 | R | mutS-DNA Mismatch Repair-(CT792) |
| CPn0942 | 1075985 | 1077754 | F | dnaG/priM-DNA Primase-(CT794) |
| CPn0943 | 1077978 | 1078238 | F | CT794.1 hypothetical protein |
| CPn0944 | 1078512 | 1078997 | F | |
| CPn0945 | 1079070 | 1079660 | F | CT795 hypothetical protein |
| CPn0946 | 1082786 | 1079745 | R | glyQ-Glycyl tRNA Synthetase-(CT796) |
| CPn0947 | 1083442 | 1084059 | F | pgsA_2-Glycerol-3-P-Phosphatydyltransferase_2-(CT797) |

TABLE 2-continued

| Gene # | From | To | Strand | Gene Function (*C. Trachomatis* Ortholog in parenthesis) |
|---|---|---|---|---|
| CPn0948 | 1085474 | 1084047 | R | glgA-Glycogen Synthase-(CT798) |
| CPn0949 | 1085929 | 1086483 | F | ccc-General Stress Protein-(CT799) |
| CPn0950 | 1086488 | 1087027 | F | pth-Peptidyl tRNA Hydrolase-(CT800) |
| CPn0951 | 1087122 | 1087457 | F | rs6-S6 Ribosomal Protein-(CT801) |
| CPn0952 | 1087478 | 1087723 | F | rs18-S18 Ribosomal Protein-(CT802) |
| CPn0953 | 1087742 | 1088248 | F | rl9-L9 Ribosomal Protein-(CT803) |
| CPn0954 | 1088286 | 1088708 | F | ychB-Predicted Kinase-(CT804) |
| CPn0955 | 1088612 | 1089175 | F | (frame-shift with 0954) |
| CPn0956 | 1089560 | 1090909 | F | CT805 hypothetical protein |
| CPn0957 | 1093788 | 1090963 | R | ide/ptr-Insulinase family/Protease III-(CT806) |
| CPn0958 | 1094785 | 1093793 | R | plsB-Glycerol-3-P Acyltransferase-(CT807) |
| CPn0959 | 1096343 | 1094799 | R | cafE-Axial Filament Protein-(CT808) |
| CPn0960 | 1096764 | 1097102 | F | CT809 hypothetical protein |
| CPn0961 | 1097118 | 1097297 | F | rl32-L32 Ribosomal Protein-(CT810) |
| CPn0962 | 1097316 | 1098275 | F | plsX-FA/Phospholipid Synthesis Protein-(CT811) |
| CPn0963 | 1098398 | 1103224 | F | pmp_21-Polymorphic Outer Membrane Protein D Family-(CT812) |
| CPn0964 | 1104758 | 1103301 | R | |
| CPn0965 | 1106736 | 1104925 | R | lpxB-Lipid A Disaccharide Synthase-(CT411) |
| CPn0966 | 1108037 | 1106748 | R | pcnB_2-PolyA Polymerase_2-(CT410) |
| CPn0967 | 1108512 | 1109885 | F | mrsA/pgm-Phosphoglucomutase-(CT815) |
| CPn0968 | 1109895 | 1111721 | F | glmS-Glucosamine-Fructose-6-P Aminotransferase-(CT816) |
| CPn0969 | 1111812 | 1112999 | F | 0969-tyrP_1-Tyrosine Transport_1-(CT817) tyrP_1-Tyrosine Transport_1-(CT817) |
| CPn0970 | 1113461 | 1114648 | F | 0970-tyrP_2-Tyrosine Transport_2-(CT818) tyrP_2-Tyrosine Transport_2-(CT818) |
| CPn0971 | 1114702 | 1115415 | F | yccA-Transport Permease-(CT819) |
| CPn0972 | 1116299 | 1115430 | R | ftsY-Cell Division Protein FtsY-(CT820) |
| CPn0973 | 1116370 | 1117527 | F | sucC-Succinyl-CoA Synthetase, Beta-(CT821) |
| CPn0974 | 1117544 | 1118422 | F | sucD-Succinyl-CoA Synthetase, Alpha-(CT822) |
| CPn0975 | 1119104 | 1119637 | F | |
| CPn0976 | 1120082 | 1121185 | F | |
| CPn0977 | 1121371 | 1122402 | F | |
| CPn0978 | 1122665 | 1123693 | F | |
| CPn0979 | 1123980 | 1125443 | F | htrA-DO Serine Protease-(CT823) |
| CPn0980 | 1126982 | 1125504 | R | *similarity to *Saccharomyces serevisiae* hypothetical 52.9 KD protein |
| CPn0981 | 1127031 | 1129952 | F | Zinc Metalloprotease (insulinase family)-(CT824) |
| CPn0982 | 1131194 | 1129962 | R | yigN family-(CT825) |
| CPn0983 | 1132000 | 1131206 | R | pssA-Glycerol-Serine Phosphatidyltransferase-(CT826) |
| CPn0984 | 1132379 | 1135510 | F | nrdA-Ribonucleoside Reductase, Large Chain-(CT827) |
| CPn0985 | 1135534 | 1136571 | F | nrdB-Ribonucleoside Reductase, Small Chain-(CT828) |
| CPn0986 | 1136724 | 1137395 | F | yggH-predicted rRNA Methylase-(CT829) |
| CPn0987 | 1137516 | 1138115 | F | ytgB-like predicted rRNA methylase-(CT830) |
| CPn0988 | 1138986 | 1138075 | R | murB-UDP-N-Acetylenolpyruvoylglucosamine Reductase-(CT831) |
| CPn0989 | 1139495 | 1139016 | R | CT832 hypothetical protein |
| CPn0990 | 1139883 | 1140440 | F | infC-Initiation Factor 3-(CT833) |
| CPn0991 | 1140421 | 1140612 | F | rl35-L35 Ribosomal Protein-(CT834) |
| CPn0992 | 1140634 | 1140996 | F | rl20-L20 Ribosomal Protein-(CT835) |
| CPn0993 | 1141014 | 1142030 | F | pheS-Phenylalanyl tRNA Synthetase, Alpha-(CT836) |
| CPn0994 | 1142398 | 1144440 | F | CT837 hypothetical protein |
| CPn0995 | 1145512 | 1144415 | R | CT838 hypothetical protein |
| CPn0996 | 1146589 | 1145519 | R | CT839 hypothetical protein |
| CPn0997 | 1146708 | 1147664 | F | mesJ-PP-loop superfamily ATPase-(CT840) |
| CPn0998 | 1147855 | 1150584 | F | ftsH-ATP-dependent zinc protease-(CT841) |
| CPn0999 | 1152847 | 1150766 | R | pnp-Polyribonucleotide Nucleotidyltransferase-(CT842) |
| CPn1000 | 1153157 | 1152891 | R | rs15-S15 Ribosomal Protein-(CT843) |
| CPn1001 | 1153405 | 1153869 | F | yfhC-cytosine deaminase-(CT844) |
| CPn1002 | 1153862 | 1154089 | F | CT845 hypothetical protein |
| CPn1003 | 1154796 | 1154092 | R | CT846 hypothetical protein |
| CPn1004 | 1155397 | 1154879 | R | CT847 hypothetical protein |
| CPn1005 | 1155933 | 1155415 | R | CT848 hypothetical protein |
| CPn1006 | 1156472 | 1155990 | R | CT849 hypothetical protein |
| CPn1007 | 1156689 | 1156907 | F | CT849.1 hypothetical protein |
| CPn1008 | 1156928 | 1158223 | F | CT850 hypothetical protein |
| CPn1009 | 1159058 | 1158186 | R | map-Methionine Aminopeptidase-(CT851) |
| CPn1010 | 1159672 | 1159067 | R | CT852 hypothetical protein |
| CPn1011 | 1160306 | 1159902 | R | CT853 hypothetical protein |
| CPn1012 | 1162193 | 1160421 | R | yzeB-ABC transporter permease-(CT854) |
| CPn1013 | 1162245 | 1163624 | F | fumC-Fumarate Hydratase-(CT855) |
| CPn1014 | 1165426 | 1163732 | R | ychM-Sulfate Transporter-(CT856) |
| CPn1015 | 1165634 | 1166893 | F | CT857 hypothetical protein (possible IM protein) |
| CPn1016 | 1167042 | 1168898 | F | CT858 hypothetical protein |
| CPn1017 | 1169006 | 1169935 | F | lytB-Metalloprotease-(CT859) |
| CPn1018 | 1169898 | 1170629 | F | |
| CPn1019 | 1172128 | 1170638 | R | CT860 hypothetical protein |
| CPn1020 | 1173679 | 1172150 | R | CT861 hypothetical protein |
| CPn1021 | 1174213 | 1173698 | R | lcrH_2-Low Calcium Response_2-(CT862) |
| CPn1022 | 1175673 | 1174216 | R | CT863 hypothetical protein |
| CPn1023 | 1176035 | 1176331 | F | |
| CPn1024 | 1177236 | 1176334 | R | xerD-Integrase/recombinase-(CT864) |

TABLE 2-continued

| Gene # | From | To | Strand | Gene Function (*C. Trachomatis* Ortholog in parenthesis) |
|---|---|---|---|---|
| CPn1025 | 1177302 | 1178879 | F | pgi-Glucose-6-P Isomerase-(CT378) |
| CPn1026 | 1178997 | 1179137 | F | ltuA-(CT377) |
| CPn1027 | 1179175 | 1180755 | F | |
| CPn1028 | 1181016 | 1181999 | F | mdhC-Malate Dehydrogenase-(CT376) |
| CPn1029 | 1182008 | 1182844 | F | |
| CPn1030 | 1183886 | 1182843 | R | predicted D-amino acid dehydrogenase-(CT375) |
| CPn1031 | 1185552 | 1184098 | R | arcD-Arginine/Ornithine Antiporter-(CT374) |
| CPn1032 | 1186150 | 1185566 | R | CT373 hypothetical protein |
| CPn1033 | 1187500 | 1186187 | R | CT372 hypothetical protein |
| CPn1034 | 1188517 | 1187732 | R | Predicted OMP__1 (CT371) [leader (18) peptide] |
| CPn1035 | 1190000 | 1188570 | R | AroE-Shikimate 5-Dehydrogenase-(CT370) |
| CPn1036 | 1191135 | 1189984 | R | AroB-Dehyroquinate Synthase-(CT369) |
| CPn1037 | 1192199 | 1191123 | R | AroC-Chorismate Synthase-(CT368) |
| CPn1038 | 1192726 | 1192199 | R | aroL-Shikimate Kinase II-(CT367) |
| CPn1039 | 1193999 | 1192665 | R | aroA-Phosphoshikimate Vinyltransferase-(CT366) |
| CPn1040 | 1194741 | 1194073 | R | |
| CPn1041 | 1195994 | 1194726 | R | *bioA-Adenosylmethionine-8-Amino-7-Oxononanoate Aminotransferase |
| CPn1042 | 1196590 | 1195934 | R | *bioD-dethiobiotin synthetase |
| CPn1043 | 1197717 | 1196572 | R | bioF__2-Oxononanoate Synthase__2 |
| CPn1044 | 1198691 | 1197699 | R | *bioB-Biotin Synthase |
| CPn1045 | 1199590 | 1198901 | R | *conserved hypothetical bacterial membrane protein |
| CPn1046 | 1200625 | 1199590 | R | *Tryptophan Hyroxylase |
| CPn1047 | 1200552 | 1201343 | F | dapB-Dihydrodipicolinate Reductase-(CT364) |
| CPn1048 | 1201606 | 1202604 | F | asd-Aspartate Dehydrogenase-(CT363) |
| CPn1049 | 1202595 | 1203914 | F | lysC-Aspartokinase III-(CT362) |
| CPn1050 | 1203926 | 1204798 | F | dapA-Dihydrodipicolinate Synthase-(CT361) |
| CPn1051 | 1204962 | 1205270 | F | |
| CPn1052 | 1205417 | 1206169 | F | |
| CPn1053 | 1206153 | 1206701 | F | |
| CPn1054 | 1207034 | 1209466 | F | |
| CPn1055 | 1209694 | 1210521 | F | |
| CPn1056 | 1210527 | 1211228 | F | |
| CPn1057 | 1211497 | 1213596 | F | CT356 hypothetical protein |
| CPn1058 | 1213748 | 1214836 | F | CT355 hypothetical protein |
| CPn1059 | 1214848 | 1215678 | F | kgsA-Dimethyladenosine Transferase-(CT354) |
| CPn1060 | 1217658 | 1215727 | R | dxs/tkt-Transketolase-(CT331) |
| CPn1061 | 1217920 | 1217666 | R | CT330 hypothetical protein |
| CPn1062 | 1219820 | 1218159 | R | xseA-Exodoxyribonuclease VII-(CT329) |
| CPn1063 | 1219951 | 1220712 | F | tpiS-Triosephosphate Isomerase-(CT328) |
| CPn1064 | 1220719 | 1220895 | F | |
| CPn1065 | 1221095 | 1220928 | R | |
| CPn1066 | 1221135 | 1221488 | F | |
| CPn1067 | 1221735 | 1222292 | F | def-Polypeptide Deformylase-(CT353) |
| CPn1068 | 1223258 | 1222365 | R | rnhB__2-Ribonuclease HII__2-(CT008) |
| CPn1069 | 1223513 | 1223941 | F | yfgA-HTH Transcriptional Regulator-(CT009) |
| CPn1070 | 1225511 | 1224144 | R | |
| CPn1071 | 1227324 | 1225885 | R | |
| CPn1072 | 1227969 | 1228835 | F | |
| CPn1073 | 1229011 | 1229832 | F | Predicted OMP__2-(CT371) |

TABLE 2

(Supplemental Data) Functional Assignments of *C. pneumoniae* Coding Sequences.
*C. trachomatis* genes are shown in parentheses.

Amino Acid Biosynthesis

Aromatic Family

| 1039 | (CT366) | aroA | Phosphoshikimate Vinyltransferase |
| 1036 | (CT369) | aroB | Dehyroquinate Synthase |
| 1037 | (CT368) | aroC | Chorismate Synthase |
| 1035 | (CT370) | aroE | Shik:mate 5-Dehyrogenase |
| 0484 | (CT382) | aroG | Deoxyheptonate Aldolase |
| 1038 | (CT367) | aroL | Shikimate Kinase II |
| 0740 | (CT637) | tyrB | Aromatic AA Aminotransferase |

Aspartate Family (lysine)

| 1048 | (CT363) | asd | Aspartate Dehydrogenase |
| 1050 | (CT361) | dapA | Dihydrodipicolinate Synthase |
| 1047 | (CT364) | dapB | Dihydrodipicolinate Reductase |

TABLE 2-continued (Supplemental Data) Functional Assignments of *C. pneumoniae* Coding Sequences.
*C. trachomatis* genes are shown in parentheses.

| | | | |
|---|---|---|---|
| 0519 | (CT430) | dapF | Diaminopimelate Epimerase |
| 1049 | (CT362) | lysC | Aspartokinase III |

Serine Family

| | | | |
|---|---|---|---|
| 0433 | (CT282) | gcsH | Glycine Cleavage System H Protein |
| 0521 | (CT432) | glyA | Serine Hydroxymethyltransferase |

Base & Nucleotide Metabolism

| | | | |
|---|---|---|---|
| 0171 | | guaA | GMP Synthase |
| 0172 | | guaB | Inosine 5'-Monophosphase Dehydrogenase |
| 0608 | | | Uridine 5'-Monophosphate Synthase |
| 0735 | | | Uridine Kinase |
| 0244 | (CT128) | adk | Adenylate Kinase |
| 0894 | (CT751) | amn | AMP Nucleosidase |
| 0568 | (CT452) | cmk | CMP Kinase |
| 0392 | (CT039) | dcd | dCTP Deaminase |
| 0059 | (CT292) | dut | dUTP Nucleotidohydrolase |
| 0120 | (CT030) | gmk | GMP Kinase |
| 0619 | (CT500) | ndk | Nucleoside-2-P Kinase |
| 0984 | (CT827) | nrdA | Ribonucleoside Reductase, Large Chain |
| 0985 | (CT828) | nrdB | Ribonucleoside Reductase, Small Chain |
| 0236 | (CT183) | pyrG | CTP Synthetase |
| 0698 | (CT678) | pyrH | UMP Kinase |
| 0273 | (CT188) | tdk | Thymidylate Kinase |
| 0659 | (CT539) | trxA | Thioredoxin |
| 0314 | (CT099) | trxB | Thioredoxin Reductase |
| 1001 | (CT844) | yfbC | Cytosine Deaminase |

Biosynthesis of Cofactors

Biotin, Lipoate & Ubiquinone

| | | | |
|---|---|---|---|
| 1041 | | bioA | Adenosylmethionine-8-Amino-7-Oxononanoate Aminotransferase |
| 1044 | | bioB | Biotin Synthase |
| 1042 | | bioD | Dethiobiotin Synthetase |
| 0923 | (CT777) | bioF_1 | Oxononanoate Synthase_1 |
| 1043 | (CT777) | bioF_2 | Oxononanoate Synthase_2 |
| 0866 | (CT725) | birA | Biotin Synthetase |
| 0748 | (CT628) | ispA | Geranyl Transtransferase |
| 0832 | (CT558) | lipA | Lipoate Synthetase |
| 0265 | (CT219) | ubiA | Benzoate Octaphenyltransferase |
| 0264 | (CT220) | ubiD | Phenylacrylate Decarboxylase |
| 0515 | (CT428) | ubiE | Ubiquinone Methyltransferase |

Folic Acid

| | | | |
|---|---|---|---|
| 0759 | (CT612) | folA | Dihydrofolate Reductase |
| 0335 | (CT078) | folD | Methylene Tetrahydrofolate Dehydrogenase |
| 0758 | (CT613) | folP | Dihydropteroate Synthase |
| 0757 | (CT614) | folX | Dihydroneopterin Aldolase |
| 0763 | (CT649) | ygfA | Formyltetrahydrofolate Cycloligase |

Porphyrin

| | | | |
|---|---|---|---|
| 0714 | (CT662) | hemA | Glutamyl tRNA Reductase |
| 0744 | (CT633) | hemB | Porphobilinogen Synthase |
| 0052 | (CT299) | hemC | Porphobilinogen Deaminase |
| 0890 | (CT747) | hemE | Uroporphyrinogen Decarboxylase |
| 0888 | (CT745) | hemG | protoporphyrinogen Oxidase |
| 0138 | (CT210) | hemL | Glutamate-1-Semialdehyde-2,1-Aminomutase |
| 0380 | (CT052) | hemN_1 | Coproporphyrinogen III Oxidase_1 |
| 0889 | (CT746) | hemN_2 | Coproporphyrinogen III Oxidase_2 |
| 0603 | (CT485) | hem2 | Ferroehetalase |

Riboflavin

| | | | |
|---|---|---|---|
| 0872 | (CT731) | ribA&ribB | GTP Cyclohydratase & DHBP Synthase |
| 0532 | (CT405) | ribC | Riboflavin Synthase |
| 0871 | (CT730) | ribD | Riboflavin Deaminase |
| 0873 | (CT732) | ribE | Ribityllumazine Synthase |
| 0320 | (CT093) | ribF | FAD Synthase |

Cell Envelope

Fatty Acid & Phospholipid Metabolism

| | | | |
|---|---|---|---|
| 0161 | (CT206) | | (predicted acyltransferase family) |
| 0922 | (CT776) | aas | Acylglycerophosphoethanolamine Acyltransferase |
| 0414 | (CT265) | accA | AcCoA Carboxylase/Transferase Alpha |
| 0183 | (CT123) | accB | Biotin Carboxyl Carrier Protein |
| 0182 | (CT124) | accC | Biotin Carboxylase |

TABLE 2-continued (Supplemental Data) Functional Assignments of *C. pneumoniae* Coding Sequences.
*C. trachomatis* genes are shown in parentheses.

| | | | |
|---|---|---|---|
| 0058 | (CT293) | accD | AcCoA Carboxylase/Transferase Beta |
| 0295 | (CT236) | acpP | Acyl Carrier Protein |
| 0313 | (CT100) | acpS | Acyl-carrier Protein Synthase |
| 0567 | (CT451) | cdsA | Phosphatidate Cytidylytransferase |
| 0297 | (CT238) | fabD | Malonyl Acyl Carrier Transcyclase |
| 0916 | (CT770) | fabF | Acyl Carrier Protein Synthase |
| 0296 | (CT237) | fabG | Oxoacyl (Carrier Protein) Reductase |
| 0298 | (CT239) | fabH | Oxoacyl Carrier Protein Synthase III |
| 0406 | (CT104) | fabI | Enoyl-Acyl-Carrier Protein Reductase |
| 0651 | (CT532) | fabZ | Myrisaoyl-Acyl Carrier Dehydratase |
| 0098 | (CT010) | htrB | Acyltransferase |
| 0271 | (CT136) | | Lysophospholipase Esterase |
| 0615 | (CT496) | pgsA_1 | Glycerol-3-P Phosphatidyltransferase_1 |
| 0947 | (CT797) | pgsA_2 | Glycerol-3-P Phosphatydyltransferase_2 |
| 0958 | (CT807) | plsB | Glycerol-3-P Acyltransferase |
| 0569 | (CT453) | plsC | Glycerol-3-P Acyltransferase |
| 0962 | (CT811) | plsX | FA/Phospholipid Synthesis Protein |
| 0839 | (CT699) | psdD | Phosphatidylserine Decarboxylase |
| 0983 | (CT826) | pssA | Glycerol-Serine Phosphatidyltransferase |
| 0921 | (CT775) | | snGlycerol-J-P Acyltransferase |
| 0654 | (CT535) | yciA | Acyl-CoA Thioesterase |
| 0877 | (CT736) | ybcL | CT736 Hypothetical Protein |
| LPS | | | |
| 0154 | (CT208) | gscA | KDO Transferase |
| 0721 | (CT655) | kdsA | KDO Synthetase |
| 0235 | (CT182) | kdsB | Deoxyoctulonosic Acid Synthetase |
| 0650 | (CT531) | lpxA | Acyl-Carrier UDP-GlcNAc O-Acyltransferase |
| 0965 | (CT411) | lpxB | Lipid A Disaccharide Synthase |
| 0652 | (CT533) | lpxC | Myristoyl GlcNac Deacetylase |
| 0302 | (CT243) | lpxD | UDP Glucosamine N-Acyltransferase |
| Membrane Proteins, Lipoproteins & Porins | | | |
| 0310 | (CT251) | 60IM | 60 kDa Inner Membrane Protein |
| 0556 | (CT442) | crpA | 15 kDa Cysteine-Rich Protein |
| 0653 | (CT534) | cutE | Apolipoprotein N-Acetyltransferase |
| 0311 | (CT252) | lgt | Prolipoprotein Diacylglycerol Transferase |
| 0558 | (CT444) | omcA | 9 kDa-Cysteine-Rich Lipoprotein |
| 0557 | (CT443) | omcB | 60 kDa Cysteine-Rich OMP |
| 0695 | (CT681) | ompA | Major Outer Membrane Protein |
| 0854 | (CT713) | ompB | Outer Membrane Protein B |
| 0781 | (CT600) | pal | Peptidoglycan-Associated Lipoprotein |
| 0300 | (CT241) | yaeT | Omp85 Homolog |
| Peptidoglycan | | | |
| 0417 | (CT268) | amiA | N-Acetylmuramoyl Alanine Amidase |
| 0780 | (CT601) | amiB | N-Acetylmuramoyl-L-Ala Amidase |
| 0672 | (CT551) | dacF | D-Ala-D-Ala Caroxypeptidase |
| 0968 | (CT816) | glmS | Glucosamine-Fructose-6-P Aminotransferase |
| 0749 | (CT629) | glmU | UDP-GlcNAc Pyrophosphorylase |
| 0900 | (CT757) | mrsY | Muramoyl-Pentapeptide Transferase |
| 0571 | (CT455) | murA | UDP-N-Acetylglucosamine Transferase |
| 0988 | (CT831) | murB | UDP-N-Acetylenolpyruvoylglucosamine Reductase |
| 0905 | (CT762) | murC&ddlA | Muramate-Ala Ligase & D-Ala-D-Alam Ligase |
| 0901 | (CT758) | murD | Muramoylalanine-Glutamate Ligase |
| 0418 | (CT269) | murE | N-Acetylmuramoylalanylglutamyl DAP Ligase |
| 0899 | (CT756) | murF | Muramoyl-DAP Ligase |
| 0904 | (CT761) | murG | Peptidoglycan Transferase |
| 0902 | (CT759) | nlpD | Muramidase (invasin repeat family) |
| 0694 | (CT682) | pbp2 | PBP2-Transglycolase/Transpeptidase |
| 0419 | (CT270) | pbp3 | Transglycolase/Transpeptidase |
| 0421 | (CT272) | yabC | PBP2B Family Methyltransferase |
| | | | Cellular Processes |
| Cell Division | | | |
| 0959 | (CT808) | cafE | Axial Filament Protein |
| 0880 | (CT739) | ftsK | Cell Division Protein FtsK |
| 0903 | (CT760) | ftsW | Cell Division Protein FtsW |
| 0972 | (CT820) | ftsY | Cell Division Protein FtsY |
| 0617 | (CT498) | gidA | FAD-dependent Oxidoreductase |
| 0805 | (CT582) | minD | Chromosome Partitioning ATPase |
| 0850 | (CT709) | mreB | Rod Shape Protein-Sugar Kinase |

TABLE 2-continued (Supplemental Data) Functional Assignments of *C. pneumoniae* Coding Sequences.
*C. trachomatis* genes are shown in parentheses.

| | | | |
|---|---|---|---|
| 0867 | (CT726) | rodA | Rod Shape Protein |
| 0684 | (CT688) | parB | Chromosome Partitioning Protein |
| Detoxtification | | | |
| 0057 | (CT294) | sodM | Superoxide Dismutase (Mn) |
| 0778 | (CT603) | ahpC | Thio-specific Antioxidant (TSA) Peroxidase |
| Signal Transduction | | | |
| 0148 | (CT145) | | S/T Protein Kinase |
| 0584 | (CT467) | asoS | Two-Component Sensor |
| 0294 | (CT235) | | cAMP-Dependent Protein Kinase Regulatory Subunit |
| 0712 | (CT664) | | (FHA domain) |
| 0478 | (CT379) | hflX | GTP Binding Protein |
| 0703 | (CT673) | | S/T Protein Kinase |
| 0095 | (CT301) | | S/T Protein Kinase |
| 0397 | (CT259) | | PP2C Phosphatase Family |
| 0037 | (CT337) | ptsH | PTS Phosphocarrier Protein Hpr |
| 0038 | (CT336) | ptsI | PTS PEP Phosphotransferase |
| 0060 | (CT291) | ptsN_1 | PTS IIA Protein_1 |
| 0061 | (CT290) | ptsN_2 | PTS IIA Protein + HTH DNA-Binding Domain |
| 0262 | (CT218) | surE | SurE-like Acid Phosphatase |
| 0838 | (CT698) | thdF | Thiophene/Furan Oxidation Protein |
| 0693 | (CT683) | | TFR Repeats-CT683 Hypothetical Protein |
| 0321 | (CT092) | ychF | GTP Binding Protein |
| 0544 | (CT418) | yhbZ | GTP binding protein |
| 0844 | (CT703) | yphC | GTPase/GTP-binding protein |
| Standard Protein Secretion | | | |
| 0115 | (CT025) | flh | Signal Recognition Particle GTPase |
| 0363 | (CT060) | flhA | Flagellar Secretion Protein |
| 0858 | (CT717) | fliI | Flagellum-specific ATP Synthase |
| 0704 | (CT672) | fliN | Flagellar Motor Switch Domain/YscQ family |
| 0815 | (CT572) | gspD | Gen. Secretion Protein D |
| 0816 | (CT571) | gspE | Gen. Secretion Protein E |
| 0817 | (CT570) | gspF | Gen. Secretion Protein F |
| 0359 | (CT064) | lepA | GTPase |
| 0110 | (CT020) | lepB | Signal Peptidase I |
| 0535 | (CT408) | lspA | Lipoprotein Signal Peptidase |
| 0260 | (CT141) | secA_1 | Protein Translocase Subunit_1 |
| 0841 | (CT701) | secA_2 | Translocase SecA_2 |
| 0564 | (CT448) | secD&secF | Protein Export Proteins SecD/SecF (fusion) |
| 0075 | (CT321) | secE | Preprotein Translocase |
| 0629 | (CT510) | secY | Translocase |
| 0848 | (CT707) | tig | Trigger Factor-Peptidyl-prolyl Isomerase |
| Transport-Related Proteins | | | |
| 0486 | | | Hypothetical Proline Permease |
| 0289 | (CT230) | aaaT | Neutral Amino Acid (Glutamate) Transporter |
| 0691 | (CT685) | abcX | ABC Transporter ATPase |
| 1031 | (CT374) | arcD | Arginine/Ornithine Antiporter |
| 0482 | (CT381) | artJ | Arginine Periplasmic Binding Protein |
| 0836 | (CT554) | brnQ | Amino Acid (Branched) Transport |
| 0536 | (CT409) | dagA_1 | D-Ala/Gly Permease_1 |
| 0876 | (CT735) | dagA_2 | D-Alanine/Glycine Permease_2 |
| 0682 | (CT690) | dppD | ABC ATPase Dipeptide Transport |
| 0683 | (CT689) | dppF | ABC ATPase Dipeptide Transport |
| 0280 | (CT689) | dppF | Dipeptide Transporter ATPase |
| 0785 | (CT596) | exbB | Macromolecule Transporter |
| 0784 | (CT597) | exbD | Biopolymer Transport Protein |
| 0604 | (CT486) | fliY | Glutamine Binding Protein |
| 0192 | (CT129) | glnP | ABC Amino Acid Transporter Permease |
| 0191 | (CT130) | glnQ | ABC Amino Acid Transporter ATPase |
| 0528 | (CT401) | gltT | Glutamate Symport |
| 0286 | (CT194) | mgtE | $Mg^{++}$ Transporter (CBS Domain) |
| 0413 | (CT264) | msbA | Transport ATP Binding Protein |
| 0290 | (CT231) | | $Na^+$-dependent Transporter |
| 0195 | (CT198) | oppA_1 | Oligopeptide Binding Protein_1 |
| 0196 | (CT198) | oppA_2 | Oligopeptide Binding Protein_2 |
| 0197 | (CT139) | oppA_3 | Oligopeptide Binding Protein_3 |
| 0198 | (CT175) | oppA_4 | Oligopeptide Binding Protein_4 |
| 0599 | (CT480) | oppA_5 | Oligopeptide Binding Lipoprotein_5 |
| 0199 | (CT199) | oppB_1 | Oligopeptide Permease_1 |
| 0598 | (CT479) | oppB_2 | Oligopeptide Permease_2 |
| 0200 | (CT200) | oppC_1 | Oligopeptide Permease_1 |
| 0597 | (CT478) | oppC_2 | Oligopeptide Permease_2 |
| 0201 | (CT201) | oppD | Oligopeptide Transport ATPase |

TABLE 2-continued (Supplemental Data) Functional Assignments of *C. pneumoniae* Coding Sequences.
*C. trachomatis* genes are shown in parentheses.

| | | | |
|---|---|---|---|
| 0202 | (CT202) | oppF | Oligopeptide Transport ATPase |
| 0231 | (CT180) | tauB | ABC Transport ATPase (Nitrate/Fe) |
| 0782 | (CT599) | tolB | Macromolecule Transporter |
| 0969 | (CT817) | tyrP_1 | Tyrosine Transport_1 |
| 0970 | (CT818) | tyrP_2 | Tyrosine Transport_2 |
| 0665 | (CT544) | uhpC | Hexosphosphate Transport |
| 0282 | (CT216) | aasA | Amino Acid Transporter |
| 0207 | (CT204) | ybhI | dicarboxylate Translocator |
| 0971 | (CT819) | yccA | Transport Permease |
| 0248 | (CT152) | ycfV | ABC Transporter ATPase |
| 1014 | (CT856) | ychM | Sulfate Transporter |
| 0736 | (CT641) | ygeD | Efflux Protein |
| 0680 | (CT692) | ygo4 | Phosphate Permease |
| 0723 | (CT653) | yhbG | ABC Transporter ATPase |
| 0023 | (CT348) | yjjK | ABC Transporter Protein ATPase |
| 0127 | (CT034) | ytlF | Cationic Amino Acid Transporter |
| 0349 | (CT067) | ytgA | Solute Protein Binding Family |
| 0348 | (CT068) | ytgB | ABC Transporter ATPase |
| 0347 | (CT069) | ytgC | Integral Membrane Protein |
| 0346 | (CT070) | ytgD | Integral Membrane Protein |
| 1012 | (CT854) | yzcB | ABC Transporter Permease |
| 0868 | (CT727) | mtA | Metal Transport P-type ATPase |
| 0279 | | | Possible ABC Transporter Permease Protein |
| 0543 | (CT417) | | (Metal Transport Protein) |
| 0692 | (CT684) | | ABC Transporter |
| 0542 | (CT416) | | ABC Transporter ATPase |
| 0690 | (CT686) | | ABC Transporter Membrane Protein |
| 0541 | (CT415) | | solute binding protein |
| Type-III Secretion | | | |
| 0323 | (CT090) | lcrD | Low Calcium Response D |
| 0324 | (CT089) | lcrE | Low Calcium Response E |
| 0811 | (CT576) | lcrH_1 | Low Ca Response Protein H_1 |
| 1021 | (CT862) | lcrH_2 | Low Calcium Response_2 |
| 0325 | (CT088) | sycE | Secretion Chaperone |
| 0702 | (CT674) | yscC | Yop C/Gen Secretion Protein D |
| 0828 | (CT559) | yscJ | Yop Translocation J |
| 0826 | (CT561) | yscL | Yop Translocation L |
| 0707 | (CT669) | yscN | Yop N (Flagellar-Type ATPase) |
| 0825 | (CT562) | yscR | Yop Translocation R |
| 0824 | (CT563) | yscS | YopS Translocation Protein |
| 0823 | (CT564) | yscT | YopT Translocation T |
| 0322 | (CT091) | ytcU | Yop Translocation Protein U |
| | | | Central Intermediary Metabolism |
| Glycogen Metabolism | | | |
| 0856 | (CT715) | | UDP-Glucose Pyrophosphorylase |
| 0948 | (CT798) | glgA | Glycogen Synthase |
| 0475 | (CT866) | glgB | Glucan Branching Enzyme |
| 0607 | (CT489) | glgC | Glucose-1-P Adenyltransferase |
| 0307 | (CT248) | glgP | Glycogen Phosphorylase |
| 0388 | (CT042) | glgX | Glycogen Hydrolase (debranching) |
| 0326 | (CT087) | malQ | Glucanotransferase |
| 0851 | (CT710) | pckA | Phosphoenolpyruvate Carboxykinase |
| Phosphorous & Sulfur | | | |
| 0548 | (CT435) | cysI | Sulfite Reductase |
| 0920 | (CT774) | cysQ | Sulfite Synthesis/Biphosphate Phosphatase |
| 0025 | (CT346) | atsA | Sulphohydrolase |
| 0918 | (CT772) | ppa | Inorganic Pyrophosphatase |
| | | | DNA Replication, Modification, Repair & Recombination |
| DNA Mismatch Repair | | | |
| 0505 | | | 3-Methyladenine DNA Glycosylase |
| 0812 | (CT575) | mutL | DNA Mismatch Repair |
| 0941 | (CT792) | mutS | DNA Mismatch Repair |
| 0402 | (CT107) | mutY | Adenine Glycosylase |
| 0732 | (CT625) | nfo | Endonuclease IV |
| 0837 | (CT697) | nth | Endonuclease III |
| DNA Modification | | | |
| 0596 | (CT477) | ada | Methyltransferase |
| 0114 | (CT024) | hemK | A/G-specific Methylase |
| 0891 | (CT748) | mfd | Transcription-Repair Coupling |

TABLE 2-continued (Supplemental Data) Functional Assignments of *C. pneumoniae* Coding Sequences.
*C. trachomatis* genes are shown in parentheses.

| | | | |
|---|---|---|---|
| 0620 | (CT501) | ruvA | Holliday Junction Helicase |
| 0390 | (CT040) | ruvB | Holliday Junction Helicase |
| 0621 | (CT502) | ruvC | Crossover Junction Endonuclease |
| 0053 | (CT298) | sms | Sms Protein |
| 0773 | (CT607) | ung | Uracil DNA Glycosylase |
| 1062 | (CT329) | xscA | Exodosyribonuclease VII |
| DNA Recombination | | | |
| 0762 | (CT650) | recA | RecA Recombination Protein |
| 0738 | (CT639) | recB | Exodeoxyribonuclease V, Beta |
| 0737 | (CT640) | recC | Exodeoxyribonuclease V, Gamma |
| 0123 | (CT033) | recD_1 | Exodeoxyribonuclease V (Alpha Subunit)_1 |
| 0752 | (CT652) | recD_2 | Exodeoxyribonuclease V, Alpha_2 |
| 0339 | (CT074) | recF | ABC Superfamily ATPase |
| 0340 | (CT074) | | (frame-shift with 0339) |
| 0563 | (CT447) | recJ | ssDNA Exonuclease |
| 0299 | (CT240) | recR | Recombination Protein |
| DNA Replication | | | |
| 0309 | (CT250) | dnaA_1 | Replication Initiation Protein_1 |
| 0424 | (CT275) | dnaA_2 | Replication Initiation Factor_2 |
| 0616 | (CT497) | dnaB | Replicative DNA Helicase |
| 0666 | (CT545) | dnaE | DNA Pol III Alpha |
| 0942 | (CT794) | dnaG | DNA Primase |
| 0338 | (CT075) | dnaN | DNA Pol III (Beta) |
| 0410 | (CT261) | dnaQ_1 | DNA Pol III Epsilon Chain_1 |
| 0655 | (CT536) | dnaQ_2 | DNA Pol III Epsilon Chain_2 |
| 0040 | (CT334) | dnaX_1 | DNA Pol III Gamma and Tau_1 |
| 0272 | (CT187) | dnaX_2 | DNA Pol III Gamma and Tau_2 |
| 0149 | (CT146) | dnU | DNA Ligase |
| 0274 | (CT189) | gyrA_1 | DNA Gyrase Subunit A_1 |
| 0716 | (CT660) | gyrA_2 | DNA Gyrase Subunit A_2 |
| 0275 | (CT190) | gyrB_1 | DNA Gyrase Subunit B_1 |
| 0715 | (CT661) | gyrB_2 | DNA Gyrase Subunit B_2 |
| 0416 | (CT267) | himD | Integration Host Factor Alpha |
| 0612 | (CT493) | polA | DNA Polymerase I |
| 0924 | (CT778) | priA | Primosomal Protein N |
| 0386 | (CT044) | ssb | SS DNA Binding Protein |
| 0835 | (CT555) | | SWI/SNF family helicase_1 |
| 0849 | (CT708) | | SWI/SNF family helicase_2 |
| 0769 | (CT643) | topA | DNA Topoisomerase I-Fused to SWI Domain |
| 0024 | (CT347) | xerC | Integrase/recombinase |
| 1024 | (CT864) | xerD | Integrase/recombinase |
| Eukaryotic-Type Chromatin Factors | | | |
| 0886 | (CT743) | hctA | Histone-Like Developmental Protein |
| 0384 | (CT046) | hctB | Histone-like Protein 2 |
| 0878 | (CT737) | | SET Domain protein |
| 0577 | (CT460) | | SWIB (YM74) Complex Protein |
| UVR Exinuclease Repair System | | | |
| 0096 | (CT333) | uvrA | Excinuclease ABC Subunit A |
| 0801 | (CT556) | uvrB | Excinuclease ABC Subunit B |
| 0940 | (CT791) | uvrC | Excinuclease ABC Subunit C |
| 0772 | (CT608) | uvrD | DNA Helicase |
| | | | Energy Metabolism |
| Aerobic | | | |
| 0855 | (CT714) | gpdA | Glycerol-3-P Dehydrogenase |
| 0743 | (CT634) | nqrA | Ubiquinone Oxidoreductase, Alpha |
| 0427 | (CT278) | nqr2 | NADH (Ubiquinone) Dehydrogenase |
| 0428 | (CT279) | nqr3 | NADH (Ubiquinone) Oxidoreductase, Gamma |
| 0429 | (CT280) | nqr4 | NADH (Ubiquinone) Reductase 4 |
| 0430 | (CT281) | nqr5 | NADH (Ubiquinone) Reductase 5 |
| 0883 | (CT740) | nqr6 | Phenolhydrolase/NADH (Ubiquinone) Oxidoreductase 6 |
| ATP Biogenesis and metabolism | | | |
| 0351 | (CT065) | adt_1 | ADP/ATP Translocase_1 |
| 0614 | (CT495) | adt_2 | ADP/ATP Translocase_2 |
| 0088 | (CT308) | atpA | ATP Synthase Subunit A |
| 0089 | (CT307) | atpB | ATP Synthase Subunit B |
| 0090 | (CT306) | atpD | ATP Synthase Subunit D |
| 0086 | (CT310) | atpE | ATP Synthase Subunit E |
| 0091 | (CT305) | atpI | ATP Synthase Subunit I |

TABLE 2-continued (Supplemental Data) Functional Assignments of *C. pneumoniae* Coding Sequences.
*C. trachomatis* genes are shown in parentheses.

| | | | |
|---|---|---|---|
| 0092 | (CT304) | atpK | ATP Synthase Subunit K |
| 0860 | (CT719) | 0iF | Flagellar M-Ring Protein |

Electron Transport Chain

| | | | |
|---|---|---|---|
| 0102 | (CT013) | cydA | Cytochrome Oxidase Subunit I |
| 0103 | (CT014) | cydB | Cytochrome Oxidase Subunit II |
| 0364 | (CT059) | | Ferredoxin |
| 0084 | (CT312) | | Predicted Ferredoxin |

Glycolysis & Gluconeogenesis

| | | | |
|---|---|---|---|
| 0281 | (CT215) | dhnA | Predicted 1,6-Fructose Biphosphate Aldolase |
| 0800 | (CT587) | eno | Enolase |
| 0624 | (CT505) | gapA | Glyceraldehyde-3-P Dehydrogenase |
| 0056 | (CT295) | mrsA | Phosphomannomutase |
| 0967 | (CT815) | pgm | Phosphoglucomutase |
| 0160 | (CT207) | pfkA_1 | Fructose-6-P Phosphotransferase_1 |
| 0208 | (CT205) | pfkA_2 | Fructose-6-P Phosphotransferase_2 |
| 1025 | (CT378) | pgi | Glucose-6-P Isomerase |
| 0679 | (CT693) | pgk | Phosphoglycerate Kinase |
| 0863 | (CT722) | pgmA | Phosphoglycerate Mutase |
| 0097 | (CT332) | pyk | Pyruvate Kinase |
| 1063 | (CT328) | tpiS | Triosephosphate Isomerase |

Pentose Phosphate Pathway

| | | | |
|---|---|---|---|
| 0239 | (CT186) | devB | Glucose-6-P Dehydrogenase (DevB family) |
| 1060 | (CT331) | dxs | Transketolase |
| 0360 | (CT063) | gnd | 6-Phosphogluconate Dehydrogenase |
| 0185 | (CT121) | rpe | Ribulose-P Epimerase |
| 0141 | (CT213) | rpiA | Ribose-5-P Isomerase A |
| 0083 | (CT313) | tal | Transaldolase |
| 0893 | (CT750) | tktB | Transketolase |
| 0238 | (CT185) | zwf | Glucose-6-P Dehydrogenase |

Pyruvate Dehydrogenase

| | | | |
|---|---|---|---|
| 0833 | (CT557) | lpdA | Lipoamide Dehydrogenase |
| 0436 | (CT285) | lplA_1 | Lipoate Protein Ligase-Like Protein |
| 0618 | (CT499) | lplA_2 | Lipoate-Protein Ligase A |
| 0033 | (CT340) | pdhA&B | Oxoisovalerate Dehydrogenase α/β Fusion |
| 0304 | (CT245) | pdhA | Pyruvate Dehydrogenase Alpha |
| 0305 | (CT246) | pdhB | Pyruvate Dehydrogenase Beta |
| 0306 | (CT247) | pdhC | Dihydrolipoamide Acetyltransferase |

TCA Cycle

| | | | |
|---|---|---|---|
| 0495 | (CT390) | aspC | Aspartate Aminotransferase |
| 1013 | (CT855) | fumC | Fumarate Hydratase |
| 1028 | (CT376) | mdhC | Malate Dehydrogenase |
| 0789 | (CT592) | sdhA | Succinate Dehydrogenase |
| 0790 | (CT591) | sdhB | Succinate Dehydrogenase |
| 0788 | (CT593) | sdhC | Succinate Dehydrogenase |
| 0378 | (CT054) | sucA | Oxoglutarate Dehydrogenase |
| 0377 | (CT055) | sucB_1 | Dihydrolipoamide Succinyltransferase_1 |
| 0527 | (CT400) | sucB_2 | Dihydrolipoamide Succinyltransferase_2 |
| 0973 | (CT821) | sucC | Succinyl-CoA Synthetase, Beta |
| 0974 | (CT822) | sucD | Succinyl-CoA Synthetase, Alpha |

Protein Folding, Assembly & Modification

Chaperones

| | | | |
|---|---|---|---|
| 0949 | (CT799) | ctc | General Stress Protein |
| 0534 | (CT407) | dksA | DnaK Suppressor |
| 0032 | (CT341) | dnaJ | Heat Shock Protein J |
| 0503 | (CT396) | dnaK | Hsp-70 |
| 0134 | (CT110) | groEL_1 | Hsp-60_1 |
| 0777 | (CT604) | groEL_2 | Hsp-60_2 |
| 0898 | (CT755) | groEL_3 | Hsp-60_3 |
| 0135 | (CT111) | groES | 10 KDa Chaperonia |
| 0502 | (CT395) | grpE | HSP-70 Cofactor |
| 0661 | (CT541) | mip | FKBP-type Peptidyl-prolyl Cis-Trans Isomerase |

Proteases

| | | | |
|---|---|---|---|
| 0144 | (CT113) | clpB | Clp Protease ATPase |
| 0437 | (CT286) | clpC | ClpC Protease |
| 0520 | (CT431) | clpP_1 | CLP Protease |
| 0847 | (CT706) | clpP_2 | CLP Protease Subunit |
| 0846 | (CT705) | clpX | CLP Protease ATPase |
| 0269 | (CT138) | | Dipeptidase |

TABLE 2-continued (Supplemental Data) Functional Assignments of *C. pneumoniae* Coding Sequences.
*C. trachomatis* genes are shown in parentheses.

| | | | |
|---|---|---|---|
| 0998 | (CT841) | ftsH | ATP-dependent Zinc Protease |
| 0030 | (CT343) | gcp_1 | O-Sialoglycoprotein Endopeptidase_1 |
| 0194 | (CT197) | gcp_2 | O-Sialoglycoprotein Endopeptidase_2 |
| 0979 | (CT823) | htrA | DO Serine Protease |
| 0957 | (CT806) | ide | Insulinase family/Protease III |
| 0027 | (CT344) | lon | Lon ATP-dependent Protease |
| 1017 | (CT859) | lytB | Metalloprotease |
| 1009 | (CT851) | map | Methionine Aminopeptidase |
| 0385 | (CT045) | pepA | Leucyl Aminopeptidase A |
| 0136 | (CT112) | pepF | Oligopeptidase |
| 0813 | (CT574) | pepP | Aminopeptidase P |
| 0613 | (CT494) | sohB | Protease |
| 0555 | (CT441) | tsp | Tail-Specific Protease |
| 0344 | (CT072) | yaeL | Metalloprotease |
| 0981 | (CT824) | | Zinc Metalloprotease (insulinase family) |
| Protein Isomerases | | | |
| 0227 | (CT176) | dsbB | Disulfide bond Oxidoreductase |
| 0786 | (CT595) | dsbD | Thio:disulfide Interchange Protein |
| 0228 | (CT177) | dsbG | Disulfide Bond Chaperone |
| 0933 | (CT783) | | Predicted Disulfide Bond Isomerase |
| 0926 | (CT780) | | Thioredoxin Disulfide Isomerase |

Transcription

RNA Degradation

| | | | |
|---|---|---|---|
| 0999 | (CT842) | pnp | Polyribonucleotide Nucleotidyltransferase |
| 0054 | (CT297) | rnc | Ribonuclease III |
| 0119 | (CT029) | rnhB_1 | Ribonuclease HII_1 |
| 1068 | (CT008) | rnhB_2 | Ribonuclease HII_2 |
| 0934 | (CT784) | rnpA | Ribonuclease P Protein Component |
| 0504 | (CT397) | vacB | Ribonuclease Family |
| RNA Elongation & Termination Factors | | | |
| 0741 | (CT636) | greA | Transcription Elongation Factor |
| 0316 | (CT097) | nusA | N Utilization Protein A |
| 0076 | (CT320) | nusG | Transcriptional Antitermination |
| 0845 | (CT704) | pcnB_1 | Poly A Polymerase_1 |
| 0966 | (CT410) | pcnB_2 | Poly A Polymerase_2 |
| 0610 | (CT491) | rho | Transcription Termination Factor |
| RNA Methylases | | | |
| 0674 | (CT553) | fmu | RNA Methyltransferase |
| 1059 | (CT354) | kgsA | Dimethyladenosine Transferase |
| 0187 | (CT133) | | Predicted Methylase |
| 0530 | (CT403) | spoU_1 | rRNA Methylase_1 |
| 0660 | (CT540) | spoU_2 | rRNA Methylase_2 |
| 0117 | (CT027) | trmD | tRNA (Guanine N-1)-Methyltransferase |
| 0885 | (CT742) | ygcA | rRNA Methyltransferase |
| 0986 | (CT829) | yggH | Predicted rRNA Methylase |
| 0987 | (CT830) | ytgB | Predicted rRNA Methylase |
| RNA Modification | | | |
| 0649 | (CT530) | fmt | Methionyl tRNA Formyltransferase |
| 0910 | (CT766) | mizA | tRNA Pyrophosphate Transferase |
| 0719 | (CT658) | sfhB | Predicted Pseudouridine Synthase |
| 0219 | (CT193) | tgt | Queuine tRNA Ribosyl Transferase |
| 0580 | (CT463) | truA | Pseudouridylate Synthase I |
| 0319 | (CT094) | truB | tRNA Pseudouridine Synthase |
| 0403 | (CT106) | yceC | Predicted Pseudouridine Synthetase Family |
| 0864 | (CT723) | yjbC | Predicted Pseudouridine Synthase |
| RNA Polymerase & Transcription Regulators | | | |
| 0586 | (CT468) | atpC | Two-Component Regulator |
| 0362 | (CT061) | rpsD | Sigma-28/WhiG Family |
| 0501 | (CT394) | hrcA | HTH Transcriptional Repressor |
| 0793 | (CT588) | rbsU | Sigma Regulatory Family Protein-PP2C Phosphatase (RsbW Antagonist) |
| 0626 | (CT507) | rpoA | RNA Polymerase Alpha |
| 0081 | (CT315) | rpoB | RNA Polymerase Beta |
| 0082 | (CT314) | rpoC | RNA Polymerase Beta' |
| 0756 | (CT615) | rpoD | RNA Polymerase Sigma-66 |
| 0771 | (CT609) | rpoN | RNA Polymerase Sigma-54 |
| 0511 | (CT424) | rsbV_1 | Sigma Regulatory Factor_1 |
| 0909 | (CT765) | rsbV_2 | Sigma Factor Regulator_2 |
| 0670 | (CT549) | rsbW | Sigma Regulatory Factor Histidine Kinase |

TABLE 2-continued (Supplemental Data) Functional Assignments of *C. pneumoniae* Coding Sequences.
*C. trachomatis* genes are shown in parentheses.

| | | | |
|---|---|---|---|
| 0750 | (CT630) | tctD | HTH Transcriptional Regulatory Protein + Receiver Doman |
| 1069 | (CT009) | yfgA | HTH Transcriptional Regulator |

Translation

Amino Acyl tRNA Synthesis

| | | | |
|---|---|---|---|
| 0892 | (CT749) | alaS | Alanyl tRNA Synthetase |
| 0570 | (CT454) | argS | Arginyl tRNA Transferase |
| 0662 | (CT542) | aspS | Aspartyl tRNA Synthetase |
| 0932 | (CT782) | cysS | Cysteinyl tRNA Synthetase |
| 0003 | (CT003) | gatA | Glu tRNA Gln Amidotransferase (A subunit) |
| 0004 | (CT004) | gatB | Glu tRNA Gln Amidotransferase (B Subunit) |
| 0002 | (CT002) | gatC | Glu tRNA Gln Amidotransferase (C subunit) |
| 0560 | (CT445) | gltX | Glutamyl-tRNA Synthetase |
| 0946 | (CT796) | glyQ | Glycyl tRNA Synthetase |
| 0663 | (CT543) | hisS | Histidyl tRNA Synthetase |
| 0109 | (CT019) | ileS | Isoleucyl-tRNA Synthetase |
| 0153 | (CT209) | leuS | Leucyl tRNA Synthetase |
| 0931 | (CT781) | lysS | Lysyl tRNA Synthetase |
| 0122 | (CT032) | metG | Methionyl-tRNA Synthetase |
| 0993 | (CT836) | pheS | Phenylalanyl tRNA Synthetase, Alpha |
| 0594 | (CT475) | pheT | Phenylalanyl tRNA Synthetase Beta |
| 0500 | (CT393) | proS | Prolyl tRNA Synthetase |
| 0870 | (CT729) | serS | Seryl tRNA Synthetase_2 |
| 0806 | (CT581) | thrS | Threonyl tRNA Synthetase |
| 0802 | (CT585) | trpS | Tryptophanyl tRNA Synthetase |
| 0361 | (CT062) | tyrS | Tyrosyl tRNA Synthetase |
| 0094 | (CT302) | valS | Valyl tRNA Synthetase |

Peptide Chain Initiation, Elongation & Termination

| | | | |
|---|---|---|---|
| 1067 | (CT353) | def | Polypeptide Deformylase |
| 0184 | (CT122) | efp_1 | Elongation Factor P_1 |
| 0895 | (CT752) | efp_2 | Elongation Factor P_2 |
| 0550 | (CT437) | fusA | Elongation Factor G |
| 0073 | (CT323) | infA | Initiation Factor IF-1 |
| 0317 | (CT096) | infB | Initiation Factor-2 |
| 0990 | (CT833) | infC | Initiation Factor 3 |
| 0113 | (CT023) | pfrA | Peptide Chain Releasing Factor 1 |
| 0576 | (CT459) | prfB | Peptide Chain Release Factor 2 |
| 0950 | (CT800) | pth | Peptidyl tRNA Hydrolase |
| 0318 | (CT095) | rbfA | Ribosome Binding Factor A |
| 0699 | (CT677) | rrf | Ribosome Releasing Factor |
| 0697 | (CT679) | tsf | Elongation Factor TS |
| 0074 | (CT322) | tufA | Elongation Factor Tu |

Ribosomal Proteins

| | | | |
|---|---|---|---|
| 0078 | (CT318) | rl1 | L1 Ribosomal Protein |
| 0644 | (CT525) | rl2 | L2 Ribosomal Protein |
| 0647 | (CT528) | rl3 | L3 Ribosomal Protein |
| 0646 | (CT527) | rl4 | L4 Ribosomal Protein |
| 0635 | (CT516) | rl5 | L5 Ribosomal Protein |
| 0633 | (CT514) | rl6 | L6 Ribosomal Protein |
| 0080 | (CT316) | rl7 | L7/L12 Ribosomal Protein |
| 0953 | (CT803) | rl9 | L9 Ribosomal Protein |
| 0079 | (CT317) | rl10 | L10 Ribosomal Protein |
| 0077 | (CT319) | rl11 | L11 Ribosomal Protein |
| 0247 | (CT125) | rl13 | L13 Ribosomal Protein |
| 0637 | (CT518) | rl14 | L14 Ribosomal Protein |
| 0630 | (CT511) | rl15 | L15 Ribosomal Protein |
| 0640 | (CT521) | rl16 | L16 Ribosomal Protein |
| 0625 | (CT506) | rl17 | L17 Ribosomal Protein |
| 0632 | (CT513) | rl18 | L18 Ribosomal Protein |
| 0118 | (CT028) | rl19 | L19 Ribosomal Protein |
| 0992 | (CT835) | rl20 | L20 Ribosomal Protein |
| 0546 | (CT420) | rl21 | L21 Ribosomal Protein |
| 0642 | (CT523) | rl22 | L22 Ribosomal Protein |
| 0645 | (CT526) | rl23 | L23 Ribosomal Protein |
| 0636 | (CT517) | rl24 | L24 Ribosomal Protein |
| 0545 | (CT419) | rl27 | L27 ribosomal protein |
| 0327 | (CT086) | rl28 | L28 Ribosomal Protein |
| 0639 | (CT520) | rl29 | L29 Ribosomal Protein |
| 0112 | (CT022) | rl31 | L31 Ribosomal Protein |
| 0961 | (CT810) | rl32 | L32 Ribosomal Protein |
| 0250 | (CT150) | rl33 | L33 Ribosomal Protein |
| 0935 | (CT785) | rl34 | L34 Ribosomal Protein |
| 0991 | (CT834) | rl35 | L35 Ribosomal Protein |

TABLE 2-continued (Supplemental Data) Functional Assignments of *C. pneumoniae* Coding Sequences.
*C. trachomatis* genes are shown in parentheses.

| | | | |
|---|---|---|---|
| 0936 | (CT786) | rl36 | L36 Ribosomal Protein |
| 0315 | (CT098) | rs1 | S1 Ribosomal Protein |
| 0696 | (CT680) | rs2 | S2 Ribosomal Protein |
| 0641 | (CT522) | rs3 | S3 Ribosomal Protein |
| 0733 | (CT626) | rs4 | S4 Ribosomal Protein |
| 0631 | (CT512) | rs5 | S5 Ribosomal Protein |
| 0951 | (CT801) | rs6 | S6 Ribosomal Protein |
| 0551 | (CT438) | rs7 | S7 Ribosomal Protein |
| 0634 | (CT515) | rs8 | S8 Ribosomal Protein |
| 0246 | (CT126) | rs9 | S9 Ribosomal Protein |
| 0549 | (CT436) | rs10 | S10 Ribosomal Protein |
| 0627 | (CT508) | rs11 | S11 Ribosomal Protein |
| 0552 | (CT439) | rs12 | S12 Ribosomal Protein |
| 0628 | (CT509) | rs13 | S13 Ribosomal Protein |
| 0937 | (CT787) | rs14 | S14 Ribosomal Protein |
| 1000 | (CT843) | rs15 | S15 Ribosomal Protein |
| 0116 | (CT026) | rs16 | S16 Ribosomal Protein |
| 0638 | (CT519) | rs17 | S17 Ribosomal Protein |
| 0952 | (CT802) | rs18 | S18 Ribosomal Protein |
| 0643 | (CT524) | rs19 | S19 Ribosomal Protein |
| 0754 | (CT617) | rs20 | S20 Ribosomal Protein |
| 0031 | (CT342) | rs21 | S21 Ribosomal Protein |
| | | | Other Categories |
| Chlamydia-Specific Proteins | | | |
| 0561 | (CT446) | Euo | CHLPS Euo Protein |
| 0804 | (CT583) | Gp6D | CHLTR Plasmid Paralog |
| 0186 | (CT119) | | Similarity to IncA_1 |
| 0291 | (CT232) | incB | Inclusion Membrane Protein B |
| 0292 | (CT233) | incC | Inclusion Membrane Protein C |
| 1026 | (CT377) | | LtuA Protein |
| 0333 | (CT080) | | LtuB Protein |
| 0005 | (CT871) | pmp_1 | Polymorphic Outer Membrane Protein G Family |
| 0013 | (CT871) | pmp_2 | Polymorphic Outer Membrane Protein G Family |
| 0014 | (CT871) | pmp_3 | Polymorphic Outer Membrane Protein G Family |
| 0015 | (CT871) | pmp_3 | PMP_3 (frame-shift with 0014) |
| 0016 | (CT874) | pmp_4 | Polymorphic Outer Membrane Protein G Family |
| 0017 | (CT871) | pmp_4 | PMP_4 (frame-shift with 0016) |
| 0018 | (CT874) | pmp_5 | Polymorphic Outer Membrane Protein G Family |
| 0019 | (CT871) | pmp_5 | PMP_5 (frame-shift with 0018) |
| 0444 | (CT871) | pmp_6 | Polymorphic Outer Membrane Protein G/I Family |
| 0445 | (CT871) | pmp_7 | Polymorphic Outer Membrane Protein G Family |
| 0446 | (CT871) | pmp_8 | Polymorphic Outer Membrane Protein G Family |
| 0447 | (CT871) | pmp_9 | Polymorphic Outer Membrane Protein G/I Family |
| 0450 | (CT871) | pmp_10 | Polymorphic Outer Membrane Protein G Family |
| 0449 | (CT871) | pmp_10 | PMP_10 (Frame-shift with 0450) |
| 0451 | (CT871) | pmp_11 | Polymorphic Outer Membrane Protein G Family |
| 0452 | (CT874) | pmp_12 | Polymorphic Outer Membrane Protein (truncated) A/I Family |
| 0453 | (CT871) | pmp_13 | Polymorphic Outer Membrane Protein G Family |
| 0454 | (CT872) | pmp_14 | Polymorphic Outer Membrane Protein H Family |
| 0466 | (CT869) | pmp_15 | Polymorphic Outer Membrane Protein E Family |
| 0467 | (CT869) | pmp_16 | Polymorphic Outer Membrane Protein E Family |
| 0468 | (CT869) | pmp_17 | Polymorphic Outer Membrane Protein E Family |
| 0469 | (CT869) | pmp_17 | PMP_17 (Frame-shift with 0468) |
| 0470 | (CT869) | pmp_17 | PMP_17 (Frame-shift with 0469) |
| 0471 | (CT870) | pmp_18 | Polymorphic Outer Membrane Protein E/F Family |
| 0539 | (CT412) | pmp_19 | Polymorphic Membrane Protein A Family |
| 0540 | (CT413) | pmp_20 | Polymorphic Membrane Protein B Family |
| 0963 | (CT812) | pmp_21 | Polymorphic Membrane Protein D Family |
| 0562 | | | CHLPS 43 kDa Protein Homolog_1 |
| 0927 | | | CHLPS 43 kDa Protein Homolog_2 |
| 0928 | | | CHLPS 43 kDa Protein Homolog_3 |
| 0929 | | | CHLPS 43 kDa Protein Homolog_4 |
| 0728 | (CT622) | | CHLPN 76 kDa Homolog_1 (CT622) |
| 0729 | (CT623) | | CHLPN 76 kDa Homolog_2 (CT623) |
| 0133 | (CT109) | | CHLPS Hypothetical Protein |
| 0332 | (CT081) | | CHLPR T2 Protein |
| Miscellaneous Enzymes/Conserved Proteins | | | |
| 0193 | | argR | Possible Arginine Repressor |
| 1046 | | | Aromatic Amino Acid Hydroxylase |
| 0232 | | | Similarity to 5'-Methylthioadenosine Nucleosidase |
| 0128 | (CT035) | | Biotin Protein Ligase |
| 0513 | (CT426) | | Fe—S Oxidoreductase_1 |
| 0911 | (CT767) | | Fe—S Oxidoreductase_2 |

TABLE 2-continued (Supplemental Data) Functional Assignments of *C. pneumoniae* Coding Sequences.
*C. trachomatis* genes are shown in parentheses.

| | | | |
|---|---|---|---|
| 0373 | (CT057) | gcpE | GcpE Protein |
| 0407 | (CT103) | | HAD Superfamily Hydrolase/Phosphatase |
| 0917 | (CT771) | | Hydrolase/Phosphatase Homolog |
| 0488 | (CT385) | ycfF | HIT Family Hydrolase |
| 0701 | (CT675) | karG | Arginine Kinase |
| 0526 | (CT399) | kpsF | GurQ/KpsF Family Sugar-P Isomerase |
| 0919 | (CT773) | ldh | Leucine Dehydrogenase |
| 0022 | (CT349) | maf | Maf protein |
| 0997 | (CT840) | mesJ | PP-loop superfamily ATPase |
| 0151 | (CT148) | mhpA | Monooxygenase |
| 0730 | (CT624) | mviN | Integral Membrane Protein |
| 0861 | (CT720) | | NifU-Related Protein |
| 0479 | (CT380) | phnP | Metal Dependent Hydrolase |
| 0106 | (CT015) | phoH | ATPase |
| 0329 | (CT084) | | Phospholipase D Superfamily |
| 0435 | (CT284) | | Phospholipase D Superfamily |
| 0581 | (CT464) | | Phosphoglycolate Phosphatase |
| 0897 | (CT754) | | Predicted Phosphohydrolase |
| 0509 | (CT422) | | Predicted Metalloenzyme |
| 1030 | (CT375) | | Predicted D-Amino Acid Dehydrogenase |
| 0531 | (CT404) | | SAM Dependent Methyltransferase |
| 0337 | (CT076) | smpB | Small Protein B |
| 0394 | (CT256) | tlyC_1 | CBS Domain Protein (Hemolysin Homolog)_1 |
| 0510 | (CT423) | tlyC_2 | CBS Domains (Hemolysin Homolog)_2 |
| 0382 | (CT048) | yabC | SAM-Dependent Methyltransferase |
| 0787 | (CT594) | yabD | PHF Superfamily (Urease/Pyrimidinase) Hydrolase |
| 0611 | (CT492) | yacE | Predicted Phosphatase/Kinase |
| 0579 | (CT462) | yacM | Sugar Nucleotide Phosphorylase |
| 0578 | (CT461) | yaeI | Phosphohydrolase |
| 0345 | (CT071) | yaeM | CT071 Hypothetical Protein |
| 0566 | (CT450) | yaeS | YaeS family Hypothetical Protein |
| 0591 | (CT472) | yagE | YagE family |
| 0039 | (CT335) | ybaB | YbaB family Hypothetical Protein |
| 0101 | (CT012) | ybbP | YbbP family Hypothetical Protein |
| 0915 | (CT769) | ybeB | iojap Superfamily Onholog |
| 0137 | (CT108) | ybgI | ACR family |
| 0529 | (CT402) | ycaH | ATPase |
| 0438 | (CT287) | ycbF | PP-loop Superfamily ATPase |
| 0734 | (CT627) | yccA | YccA Hypothetical Protein |
| 0954 | (CT804) | ychB | Predicted Kinase |
| 0261 | (CT217) | ydaO | PP-Loop Superfamily ATPase |
| 0245 | (CT127) | ydhO | Polysaccharide Hydrolase-Invasin Repeat Family |
| 0573 | (CT457) | yebC | YebC Family Hypothetical Protein |
| 0689 | (CT687) | yfhO_1 | NifS-related Aminotransferase_1 |
| 0862 | (CT721) | yfhO_2 | NifS-related Aminotransferase_2 |
| 0547 | (CT434) | ygbB | YgbB Family Hypothetical Protein |
| 0237 | (CT184) | yggF | YggF Family Hypothetical Protein |
| 0775 | (CT606) | yggY | YggY Family Hypothetical Protein |
| 0396 | (CT258) | yhfO_3 | NifS-related Aminotransferase_3 |
| 0605 | (CT487) | yhhF | Predicted Methylase |
| 0575 | (CT458) | yhhY | Amino Group Acetyl Transferase |
| 0592 | (CT473) | yidD | YidD Family |
| 0982 | (CT825) | yigN | YigN Family Hypothetical Protein |
| 0657 | (CT537) | yjeE | YjeE Hypothetical Protein |
| 0768 | (CT644) | yohI | YohI Predicted Oxidoreductase |
| 0336 | (CT077) | yojL | YojL Hypothetical Protein |
| 0217 | (CT140) | ypdP | YpdP Hypothetical Protein |
| 0140 | (CT212) | yqdE | YqdE Hypothetical Protein |
| 0263 | (CT221) | yqfU | YqfU Hypothetical Protein |
| 0139 | (CT211) | yqgE | YqgE Hypothetical Protein |
| 0270 | (CT137) | ywlC | SuAS Superfamily-related Protein |
| 0879 | (CT738) | yycJ | Metal Dependent Hydrolase |
| | | | Homologs to CHLTR Hypothetical Coding Genes |
| 0001 | (CT001) | | CT001 Hypothetical Protein |
| 0020 | (CT351) | | CT351 Hypothetical Protein |
| 0021 | (CT350) | | CT350 Hypothetical Protein |
| 0026 | (CT345) | | CT345 Hypothetical Protein |
| 0035 | (CT339) | | CT339 Hypothetical Protein |
| 0036 | (CT338) | | CT338 Hypothetical Protein |
| 0055 | (CT296) | | CT296 Hypothetical Protein |
| 0062 | (CT289) | | CT289 Hypothetical Protein |
| 0065 | (CT288) | | CT288 Hypothetical Protein |
| 0068 | (CT360) | | CT360 Hypothetical Protein |
| 0071 | (CT325) | | CT325 Hypothetical Protein |
| 0072 | (CT324) | | CT324 Hypothetical Protein |

TABLE 2-continued (Supplemental Data) Functional Assignments of *C. pneumoniae* Coding Sequences.
*C. trachomatis* genes are shown in parentheses.

| | | |
|---|---|---|
| 0085 | (CT311) | CT311 Hypothetical Protein |
| 0087 | (CT309) | CT309 Hypothetical Protein |
| 0093 | (CT303) | CT303 Hypothetical Protein |
| 0100 | (CT011) | CT011 Hypothetical Protein |
| 0104 | (CT017) | CT017 Hypothetical Protein |
| 0105 | (CT016) | CT016 Hypothetical Protein |
| 0107 | (CT058) | CT058 Hypothetical Protein_1 |
| 0108 | (CT018) | CT018 Similarity |
| 0111 | (CT021) | CT021 Hypothetical Protein |
| 0121 | (CT031) | CT031 Hypothetical Protein |
| 0129 | (CT036) | CT036 Similarity |
| 0145 | (CT114) | CT114 Hypothetical Protein |
| 0150 | (CT147) | CT147 Hypothetical Protein |
| 0152 | (CT149) | CT149 Hypothetical Protein |
| 0176 | (CT153) | CT153 Hypothetical Protein |
| 0188 | (CT132) | CT132 Hypothetical Protein |
| 0189 | (CT131) | CT131 Hypothetical Protein |
| 0206 | (CT203) | CT203 Hypothetical Protein |
| 0229 | (CT178) | CT178 Hypothetical Protein |
| 0230 | (CT179) | CT179 Hypothetical Protein |
| 0234 | (CT181) | CT181 Hypothetical Protein |
| 0249 | (CT151) | CT151 Hypothetical Protein |
| 0253 | (CT144) | CT144 Hypothetical Protein_1 |
| 0254 | (CT143) | CT143 Hypothetical Protein_1 |
| 0255 | (CT142) | CT142 Hypothetical Protein_1 |
| 0256 | (CT144) | CT144 Hypothetical Protein_2 |
| 0257 | (CT143) | CT143 Hypothetical Protein_2 |
| 0259 | (CT142) | CT142 Hypothetical Protein_2 |
| 0276 | (CT191) | CT191 Hypothetical Protein |
| 0288 | (CT195) | CT195 Hypothetical Protein |
| 0293 | (CT234) | CT234 Hypothetical Protein |
| 0301 | (CT242) | CT368 Hypothetical Protein |
| 0303 | (CT244) | CT244 Hypothetical Protein |
| 0308 | (CT249) | CT249 Similarity |
| 0312 | (CT101) | CT101 Hypothetical Protein |
| 0328 | (CT085) | CT085 Hypothetical Protein |
| 0330 | (CT083) | CT083 Hypothetical Protein |
| 0331 | (CT082) | CT082 Hypothetical Protein |
| 0334 | (CT079) | CT079 Similarity |
| 0342 | (CT073) | CT073 Hypothetical Protein |
| 0343 | (CT073) | (frame-shift with 0342?) |
| 0350 | (CT066) | CT066 Hypothetical Protein |
| 0369 | (CT058) | CT058 Hypothetical Protein_2 |
| 0370 | (CT058) | CT058 Hypothetical Protein_3 |
| 0374 | (CT056) | CT056 Hypothetical Protein |
| 0379 | (CT053) | CT053 Hypothetical Protein |
| 0381 | (CT326) | CT326 Similarity |
| 0383 | (CT047) | CT047 Hypothetical Protein |
| 0387 | (CT043) | CT043 Hypothetical Protein |
| 0389 | (CT041) | CT041 Hypothetical Protein |
| 0393 | (CT038) | CT038 Hypothetical Protein |
| 0395 | (CT257) | CT257 Hypothetical Protein |
| 0399 | (CT253) | CT253 Hypothetical Protein |
| 0400 | (CT254) | CT254 Hypothetical Protein |
| 0401 | (CT255) | CT255 Hypothetical Protein |
| 0405 | (CT105) | CT105 Hypothetical Protein |
| 0408 | (CT102) | CT102 Hypothetical Protein |
| 0409 | (CT260) | CT260 Hypothetical Protein |
| 0411 | (CT262) | CT262 Hypothetical Protein |
| 0412 | (CT263) | CT263 Hypothetical Protein |
| 0415 | (CT266) | CT266 Hypothetical Protein |
| 0420 | (CT271) | CT271 Hypothetical Protein |
| 0422 | (CT273) | CT273 Hypothetical Protein |
| 0423 | (CT274) | CT274 Hypothetical Protein |
| 0425 | (CT276) | CT276 Hypothetical Proteins |
| 0426 | (CT277) | CT277 Similarity |
| 0434 | (CT283) | CT283 Hypothetical Protein |
| 0441 | (CT007) | CT007 Hypothetical Protein |
| 0442 | (CT006) | CT006 Hypothetical Protein |
| 0443 | (CT005) | CT005 Hypothetical Protein |
| 0474 | (CT365) | CT365 Hypothetical Protein |
| 0476 | (CT865) | CT865 Hypothetical Protein |
| 0480 | (CT383) | CT383 Hypothetical Protein |
| 0485 | (CT382) | CT382.1 Hypothetical Protein |
| 0487 | (CT384) | CT384 Hypothetical Protein |
| 0489 | (CT386) | CT386 Hypothetical Protein |

TABLE 2-continued (Supplemental Data) Functional Assignments of *C. pneumoniae* Coding Sequences.
*C. trachomatis* genes are shown in parentheses.

| | | |
|---|---|---|
| 0490 | (CT387) | CT387 Hypothetical Protein |
| 0491 | (CT389) | CT389 Hypothetical Protein |
| 0496 | (CT391) | CT391 Hypothetical Protein |
| 0497 | (CT388) | CT388 Hypothetical Protein |
| 0506 | (CT421) | CT421 Hypothetical Protein |
| 0507 | (CT421) | CT421.1 Hypothetical Protein |
| 0508 | (CT421) | CT421.2 Hypothetical Protein |
| 0512 | (CT425) | CT425 Hypothetical Protein |
| 0514 | (CT427) | CT427 Hypothetical Protein |
| 0518 | (CT429) | CT429 Hypothetical Protein |
| 0522 | (CT433) | CT433 Hypothetical Protein |
| 0525 | (CT398) | CT398 Hypothetical Protein |
| 0533 | (CT406) | CT406 Hypothetical Protein |
| 0537 | (CT814) | CT814.1 Hypothetical Protein |
| 0538 | (CT814) | CT814 Hypothetical Protein |
| 0554 | (CT440) | CT440 Hypothetical Protein |
| 0559 | (CT441) | CT441.1 Hypothetical Protein |
| 0565 | (CT449) | CT449 Hypothetical Protein |
| 0572 | (CT456) | CT456 Hypothetical Protein |
| 0582 | (CT465) | CT465 Hypothetical Protein |
| 0583 | (CT466) | CT466 Hypothetical Protein |
| 0588 | (CT469) | CT469 Hypothetical Protein |
| 0589 | (CT470) | CT470 Hypothetical Protein |
| 0590 | (CT471) | CT471 Hypothetical Protein |
| 0593 | (CT474) | CT474 Hypothetical Protein |
| 0595 | (CT476) | CT476 Hypothetical Protein |
| 0601 | (CT483) | CT483 Hypothetical Protein |
| 0602 | (CT484) | CT484 Hypothetical Protein |
| 0606 | (CT488) | CT488 Hypothetical Protein |
| 0609 | (CT490) | CT490 Hypothetical Protein |
| 0622 | (CT503) | CT503 Hypothetical Protein |
| 0623 | (CT504) | CT504 Hypothetical Protein |
| 0648 | (CT529) | CT529 Hypothetical Protein |
| 0658 | (CT538) | CT538 Hypothetical Protein |
| 0667 | (CT546) | CT546 Hypothetical Protein |
| 0668 | (CT547) | CT547 Hypothetical Protein |
| 0669 | (CT548) | CT548 Hypothetical Protein |
| 0671 | (CT550) | CT550 Hypothetical Protein |
| 0673 | (CT552) | CT552 Hypothetical Protein |
| 0675 | (CT696) | CT696 Hypothetical Protein |
| 0676 | (CT695) | CT695 Similarity |
| 0681 | (CT691) | CT691 Hypothetical Protein |
| 0687 | (CT482) | CT482 Hypothetical Protein |
| 0688 | (CT481) | CT481 Hypothetical Protein |
| 0700 | (CT676) | CT676 Hypothetical Protein |
| 0705 | (CT671) | CT671 Hypothetical Protein |
| 0706 | (CT670) | CT670 Hypothetical Protein |
| 0708 | (CT668) | CT668 Hypothetical Protein |
| 0709 | (CT667) | CT667 Hypothetical Protein |
| 0710 | (CT666) | CT666 Hypothetical Protein |
| 0711 | (CT665) | CT665 Hypothetical Protein |
| 0713 | (CT663) | CT663 Hypothetical Protein |
| 0717 | (CT656) | CT656 Hypothetical Protein |
| 0718 | (CT657) | CT657 Hypothetical Protein |
| 0720 | (CT659) | CT659 Hypothetical Protein |
| 0722 | (CT654) | CT654 Hypothetical Protein |
| 0725 | (CT652) | CT652.1 Hypothetical Protein |
| 0726 | (CT620) | CT620 Hypothetical Protein |
| 0727 | (CT619) | CT619 Hypothetical Protein |
| 0739 | (CT638) | CT368 Hypothetical Protein |
| 0742 | (CT635) | CT635 Hypothetical Protein |
| 0746 | (CT632) | CT632 Hypothetical Protein |
| 0747 | (CT631) | CT631 Hypothetical Protein |
| 0751 | (CT651) | CT651 Hypothetical Protein |
| 0755 | (CT616) | CT616 Hypothetical Protein |
| 0760 | (CT611) | CT611 Hypothetical Protein |
| 0761 | (CT610) | CT610 Hypothetical Protein |
| 0764 | (CT648) | CT648 Hypothetical Protein |
| 0765 | (CT647) | CT647 Hypothetical Protein |
| 0766 | (CT646) | CT646 Hypothetical Protein |
| 0767 | (CT645) | CT645 Hypothetical Protein |
| 0770 | (CT642) | CT642 Hypothetical Protein |
| 0774 | (CT606) | CT606.1 Hypothetical Protein |
| 0776 | (CT605) | CT605 Hypothetical Protein |
| 0779 | (CT602) | CT602 Hypothetical Protein |
| 0783 | (CT598) | CT598 Hypothetical Protein |

TABLE 2-continued (Supplemental Data) Functional Assignments of *C. pneumoniae* Coding Sequences.
*C. trachomatis* genes are shown in parentheses.

| | | |
|---|---|---|
| 0791 | (CT590) | CT590 Hypothetical Protein |
| 0792 | (CT589) | CT589 Hypothetical Protein |
| 0803 | (CT584) | CT584 Hypothetical Protein |
| 0807 | (CT580) | CT580 Hypothetical Protein |
| 0808 | (CT579) | CT579 Hypothetical Protein |
| 0809 | (CT578) | CT578 Hypothetical Protein |
| 0810 | (CT577) | CT577 Hypothetical Protein |
| 0814 | (CT573) | CT573 Hypothetical Protein |
| 0818 | (CT569) | CT569 Hypothetical Protein |
| 0819 | (CT568) | CT568 Hypothetical Protein |
| 0820 | (CT567) | CT567 Hypothetical Protein |
| 0821 | (CT566) | CT566 Hypothetical Protein |
| 0822 | (CT565) | CT565 Hypothetical Protein |
| 0827 | (CT560) | CT560 Hypothetical Protein |
| 0834 | (CT556) | CT556 Hypothetical Protein |
| 0840 | (CT700) | CT700 Hypothetical Protein |
| 0842 | (CT702) | CT702 Hypothetical Protein |
| 0843 | (CT702) | CT702 Hypothetical Protein |
| 0852 | (CT711) | CT711 Hypothetical Protein |
| 0853 | (CT712) | CT712 Hypothetical Protein |
| 0857 | (CT716) | CT716 Hypothetical Protein |
| 0859 | (CT718) | CT718 Hypothetical Protein |
| 0865 | (CT724) | CT724 Hypothetical Protein |
| 0869 | (CT728) | CT728 Hypothetical Protein |
| 0874 | (CT733) | CT733 Hypothetical Protein |
| 0875 | (CT734) | CT734 Hypothetical Protein |
| 0884 | (CT741) | CT741 Hypothetical Protein |
| 0887 | (CT744) | CHLTR Possible Phosphoprotein |
| 0896 | (CT753) | CT753 Hypothetical Protein |
| 0906 | (CT763) | CT763 Hypothetical Protein |
| 0908 | (CT764) | CT764 Hypothetical Protein |
| 0912 | (CT768) | CT768 Hypothetical Protein |
| 0925 | (CT779) | CT779 Hypothetical Protein |
| 0938 | (CT788) | CT788 Hypothetical Protein |
| 0939 | (CT790) | CT790 Hypothetical Protein |
| 0943 | (CT794) | CT794.1 Hypothetical Protein |
| 0945 | (CT795) | CT795 Hypothetical Protein |
| 0956 | (CT805) | CT805 Hypothetical Protein |
| 0960 | (CT809) | CT809 Hypothetical Protein |
| 0989 | (CT832) | CT832 Hypothetical Protein |
| 0994 | (CT837) | CT837 Hypothetical Protein |
| 0995 | (CT838) | CT838 Hypothetical Protein |
| 0996 | (CT839) | CT839 Hypothetical Protein |
| 1002 | (CT845) | CT845 Hypothetical Protein |
| 1003 | (CT846) | CT846 Hypothetical Protein |
| 1004 | (CT847) | CT847 Hypothetical Protein |
| 1005 | (CT848) | CT848 Hypothetical Protein |
| 1006 | (CT849) | CT849 Hypothetical Protein |
| 1007 | (CT849) | CT849.1 Hypothetical Protein |
| 1008 | (CT850) | CT850 Hypothetical Protein |
| 1010 | (CT852) | CT852 Hypothetical Protein |
| 1011 | (CT853) | CT853 Hypothetical Protein |
| 1015 | (CT857) | CT857 Hypothetical Protein |
| 1016 | (CT858) | CT858 Hypothetical Protein |
| 1019 | (CT860) | CT860 Hypothetical Protein |
| 1020 | (CT861) | CT861 Hypothetical Protein |
| 1022 | (CT863) | CT863 Hypothetical Protein |
| 1032 | (CT373) | CT373 Hypothetical Protein |
| 1033 | (CT372) | CT372 Hypothetical Protein |
| 1034 | (CT371) | CT371 Hypothetical Protein |
| 1057 | (CT356) | CT356 Hypothetical Protein |
| 1058 | (CT355) | CT355 Hypothetical Protein |
| 1061 | (CT330) | CT330 Hypothetical Protein |
| 1073 | (CT371) | CT371 Hypothetical Protein |
| | | Coding Genes Not in *C. trachamatis* |
| 0486 | | Hypothetical Proline Permease |
| 0279 | | Possible ABC Transporter Permease Protein |
| 0505 | | 3-Methyladenine DNA Glycosylase |
| 0193 | argR | Similarity to Arginine Repressor |
| 1041 | bioA | Adenosylmethionine-8-Amino-7-Oxononanoate Aminotransferase |
| 1044 | bioB | Biotin Synthase |
| 1042 | bioD | Dethiobiotin synthetase |
| 0585 | | Similarity to Cps IncA_2 |
| 0562 | | CHLPS 43 kDa Protein Homolog_1 |
| 0927 | | CHLPS 43 kDa Protein Homolog_2 |

TABLE 2-continued (Supplemental Data) Functional Assignments of *C. pneumoniae* Coding Sequences.
*C. trachomatis* genes are shown in parentheses.

| | | |
|---|---|---|
| 0928 | | CHLPS 43 kDa Protein Homolog_3 |
| 0929 | | CHLPS 43 kDa Protein Homolog_4 |
| 1045 | | Conserved Hypothetical Membrane Protein |
| 0251 | | Conserved Hypothetical Protein |
| 0278 | | Conserved Outer Membrane Lipoprotein Protein |
| 0907 | | CutA-like Periplasmic Divalent Cation Tolerance Protein |
| 0171 | gusA | GMP Synthase |
| 0172 | gusB | Inosine 5'-Monophosphase Dehydrogenase |
| 0608 | | Uridine 5'-Monophosphate Synthase |
| 0735 | | Uridine Kinase |
| 0980 | | Similar to *Saccharomyces cerevisiae* 52.9 KDa Protein |
| 0232 | | Similarity to 5'-Methylthioadenosine Nucleosidase |
| 1046 | | Tryptophan Hydroxylase |
| 0477 | yqeV_Bs | Conserved Hypothetical Protein |
| 0048 | yqfF-Bs | Conserved Hypothetical IM Protein |
| 0587 | yvyD_Bs | Conserved Hypothetical Protein |
| 0143 | yxjG_Bs_1 | Conserved Hypothetical Protein |
| 0448 | yxjG_Bs_2 | Conserved Hypothetical Protein |
| 0006 | | |
| 0007 | | |
| 0008 | | |
| 0009 | | |
| 0010 | | |
| 0011 | | |
| 0012 | | |
| 0028 | | |
| 0029 | | |
| 0034 | | |
| 0041 | | |
| 0042 | | |
| 0043 | | |
| 0044 | | |
| 0045 | | |
| 0046 | | |
| 0047 | | |
| 0049 | | |
| 0050 | | |
| 0051 | | |
| 0063 | | |
| 0064 | | |
| 0066 | | |
| 0067 | | |
| 0069 | | |
| 0070 | | |
| 0099 | | |
| 0124 | | |
| 0125 | | |
| 0126 | | |
| 0130 | | |
| 0131 | | |
| 0132 | | |
| 0142 | | |
| 0146 | | |
| 0147 | | |
| 0155 | | |
| 0156 | | |
| 0157 | | |
| 0158 | | |
| 0159 | | |
| 0162 | | |
| 0163 | | |
| 0164 | | |
| 0165 | | |
| 0166 | | |
| 0167 | | |
| 0168 | | |
| 0169 | | |
| 0170 | | |
| 0173 | | |
| 0174 | | |
| 0175 | | |
| 0177 | | |
| 0178 | | |
| 0179 | | |
| 0180 | | |
| 0181 | | |

TABLE 2-continued (Supplemental Data) Functional Assignments of *C. pneumoniae* Coding Sequences.
*C. trachomatis* genes are shown in parentheses.

0190
0203
0204
0205
0209
0210
0211
0212
0213
0214
0215
0216
0218
0220
0221
0222
0223
0224
0225
0226
0233
0240
0241
0242
0243
0266
0267
0268
0277
0283
0284
0285
0287
0352
0353
0354
0355
0356
0357
0358
0365
0366
0367
0368
0371
0372
0375
0376
0391
0398
0404
0431
0432
0439
0440
0455
0456
0457
0458
0459
0460
0461
0462
0463
0464
0465
0472
0473
0481
0483
0492
0493
0494
0498
0499
0516

TABLE 2-continued (Supplemental Data) Functional Assignments of *C. pneumoniae* Coding Sequences.
*C. trachomatis* genes are shown in parentheses.

0517
0523
0524
0553
0574
0600
0656
0664
0677
0678
0685
0686
0724
0731
0745
0753
0794
0795
0796
0797
0798
0799
0829
0830
0831
0881
0882
0913
0914
0930
0944
0964
0975
0976
0977
0978
1018
1023
1027
1029
1040
1051
1052
1053
1054
1055
1056
1064
1065
1066
1070
1071
1072

| tRNA # | Begin | End | Type | Codon | tRNA # | Begin | End | Type | Codon |
|---|---|---|---|---|---|---|---|---|---|
| 1 | 89657 | 89728 | Thr | GGT | 13 | 784822 | 784896 | Glu | TTC |
| 2 | 90998 | 91070 | Trp | CCA | 14 | 784922 | 784994 | Lys | TTT |
| 3 | 199301 | 199229 | Met | CAT | 15 | 836119 | 836191 | Ala | GGC |
| 4 | 199390 | 199317 | Met | CAT | 16 | 843926 | 843999 | Pro | GGG |
| 5 | 296075 | 296147 | Val | TAC | 17 | 877400 | 877473 | Arg | ACG |
| 6 | 296151 | 296224 | Asp | GTC | 18 | 1085605 | 1085676 | Gln | TTG |
| 7 | 409848 | 409922 | Pro | TGG | 19 | 1142034 | 1142118 | Ser | TGA |
| 8 | 462141 | 462214 | Arg | CCT | 20 | 1175863 | 1175944 | Leu | TAG |
| 9 | 672236 | 672318 | Leu | CAA | 21 | 1230028 | 1229942 | Ser | CGA |
| 10 | 677264 | 677337 | Arg | TCG | 22 | 1137462 | 1137389 | Val | GAC |
| 11 | 739403 | 739486 | Leu | CAG | 23 | 1030603 | 1030533 | Cys | GCA |
| 12 | 781610 | 781680 | Gly | TCC | 24 | 1000022 | 999949 | His | GTG |

-continued

| tRNAs | | | | |
|---|---|---|---|---|
| tRNA # | Begin | End | Type | Codon |
| 25 | 961607 | 961536 | Gly | GCC |
| 26 | 807413 | 807341 | Arg | TCT |
| 27 | 786780 | 786708 | Thr | CGT |
| 28 | 715971 | 715889 | Leu | TAA |
| 29 | 708441 | 708354 | Ser | GCT |
| 30 | 680259 | 680178 | Leu | GAG |
| 31 | 631445 | 631373 | Phe | GAA |
| 32 | 626987 | 626901 | Ser | GGA |
| 33 | 293477 | 293405 | Thr | TGT |
| 34 | 293399 | 293317 | Tyr | GTA |
| 35 | 269142 | 269070 | Ala | TGC |
| 36 | 269065 | 268992 | Ile | GAT |
| 37 | 1643089 | 164318 | Asn | GTT |
| 38 | 87522 | 87450 | Met | CAT |

SEQUENCE LISTING (1074 sequences)

SEQ ID NO: 1 - DNA, 1230230 bp, Chlamydia pneumoniae
ctaatttttgtcagaatgatgagagtggcagcctcctgaagagcagctgtctccgtgtgaatgacgggacttcttgctgcagaaaggacaaaagcttagcaagcaaatgacaccagcaattccaatgataatataggtaatttgggtggcaggagtagaaacgcctccacacaacttagcaataatatttaatttattgtgagtgattcctataagtcccacgttcaatgcacaaagaataacaataagagaggataatcctcgaataattttgcctagcatcgcttttctcctaagtgatgtatacttaatttcatcttttaatcttttttataatttaataaacagtttttttcaaaagacttctttgctaaagtctctcagtctcgttgactttttgaatacaaaggtttaagttgttcaagaagtttttgaactgtaaacaacttccagtttttatgattagagagacagttcagaataaaaacttcaattttttaagtttagataatctttctttacttgcattgagaaaagagcatatttttataagccgcaatttaggataacatatggagcaatttcatttggatagggaagaaattttacttttggcaaaggcctcagcactacaactttctgaagagcttatccaggagtatcaaacttctttaagcgctgtgattacttctatgaaagaagctcttgccatagagattgatgatgcggattcatgcgaatctctttttatgcatgtagtaaatgttgaagatttgagagaagattcggtgacctctgatttcaatcgagaggaatttttgcgtaatgttccagagtctttagggggattagtgaaagttcctgcggtaatcaagtaagggagtctgaaaaattatgtatcgatatagtgctttagaattagcaaaagctgtgactttaggggaactgacagccacaggggtgactcaacatttttttcatagaatagaagaagctgaggggcaggtaggtgcctttatttccttgtgtaaggaacaagctttagaacaggcagagctcatagataaaaagcgttcgcgtggagaacctttaggaaaactcgcaggtgttcctgtaggaattaaagataatattcacgttacaggcctgaagacaacatgcgcctctcgtgtgctcgagaattatcaaccaccgtttgatgctactgttgtagaaagaatcaaaaaagaagatgggattatcttaggcaaactcaatatggatgagtttgctatgggatcaacaacgctatattctgcttttcatcctacccacaacccctgggatttatctcgtgttcctggaggttcttcagggggatctgcggccgcagtttctgctagattttgtcccgtagccctaggatcagataccggaggatccatccgtcagcccgcagcattttgtggtgttgtaggttttaagccttcctacggagccgtttcgcgttacgggcttgtagcctttgcctcttcgctagatcaaatcggtcctttagccaatactgtagaagacgtcgccctaatgatggatgtgttttctggtagagatcctaaagatgcaacctcaagagagtttttccgtgattcttttatgagcaagttgtctacggaggttcctaaagtgattggggtgcctagaacatttttagagggactccgtgatgatattagggagaatttcttctcttcattagccatttttgaaggagaaggaacccatcttgtggatgtggagttggatattctcagccacgctgtatctatatattacattttagcatctgctgaagctgccacgaatttagcaaggttcgatggggtgcgttatggatatcgttctcctcaagcgcataccatcagccaactctacgatctctcacgtggagaaggatttggcaaagaggtcatgcgcagaatcctcttagggaactatgtcttgtctgcggagagacagaatgtttattataagaaagctacggcagtgcgtgctaagattgtaaaagcatttagaactgcatttgaaaagtgtgaaatcttagccatgcccgtctgttctagccccgcgtttgaaataggagaaattctagatcctgtgactttatatctacaggatatctatactgtagctatgaatttagcgtatcttcctgccattgccgtaccctctggattttctaaggagggcctgcccttaggcctacagattatcggacagcaaggacaagaccaacaagtgtgccaagtgggttacagtttccaagagcatgcgcaaattaagcaattgttttctaagagatatgccaaaagtgttgttctaggaggtcaatcatgagtgctgtttatgcagattgggaatcagtcataggacttgaagttcacgtagaattgaacacagcatccaagttatttagctctgctttaaatcgctttggagatgaaccaaacactaatatttctacagtatgtacaggattgccaggatcattgcctgtattgaatcagagtgccgtggagaaagctgtgctttttggctgcgctgtcgaaggtgaaatctctctattgagtcgtttcgataggaagtcttacttctatcccgatagtcccaggaattttcaaattacacaattcgaacatcctattatccgaggaggacgcattaaggcgattgtccaaggggaagagcgttattttgaattagcccaaacccatatagaagatgatgccggaatgctgaagcacttcggagagtttgccggtgtagactacaatcgtgccggagtccccctaatcgaaattgtttcaaaaccctgtatgttttgtcctgaagatgctgttgcttacgcaacttctttggtttccttgttagactatattggaatttccgattgcaatatggaagaaggctccatccgttttgatgtcaatgtctccgtacgccctaagggatccccagaacttcgcaataaggtagaaatcaagaatatgaactccttcgcttttatggcacaagctttagaagctgaaaaacaacgtcagatcgatgagtatcttaatcagccaaataaagatcccaagctggtgattccagccgctacctaccgctgggatcccgaaaagaaaaaaactgtgctgatgcgtctcaaagagagtgccgaagattataaatattttcccgagcctgatctgccgacactacaattgacagagtcctatatagaaaggattcgcaagaccttgccagaacttccttatgacaagtaccatcgctatattcaggagtacggtctatccgaagatatcgcaagtattctgatcagcgataagaatatcgcaacgttttttgaagtcgcttgtaaagattgtaaaaactttaggtctttatctaactgggtaaccgttgaatttggaggccgctgcaaaaccctaggagtgaagttgccatcttcaggaattttccccgagggagtcgctcagctggtcaacgcaatcgaccaaggtgtgatcacagggaaaattgctaaggaaatcgcagatcttatgatggaatccccaggaaagaatcctgaggagattttaaaagagaagccagagctgcttcccatgtcagatgaaggggaattgcagaaaattatcgcagaggtggttcttgcaaatcctgaatctatcgtagactataaaaatggaaagactaaggctctaggattcctagtcgggcagattatgaagcgtacagcaggaaaagctcctcccaagcgagtgaacgaacttttacttttagaattagataagggctagaattttctgtcacagtctgtcttaaaaaatcataaaagcatgttagagatctttctaacatgctttttttatctaaatacacatttctaagttgcaaaaacgaaagcagaaaatttcgatttgcctttctacctacactttatggatccatcagaattaaattttgcaaagccatgtctacgcgggagataattctttttaagtgacaagaaattcttgtgctcggcttgctttcttattcttattgacgtattgcttgatcagatattcattttgatttaggtactaaaatgcgattttcgctctgcggatttcctctagttttttcttttacattgctctcagtcttcgacacttctttgagtgctactacgatttctttaaccccagaagatagttttcatggagatagtcagaatgcagaacgttcttataatgttcaagctggggatgtctatagccttactggtgatgtctcaatatctaacgtcgataactctgcattaaataaagcctgcttcaatgtgacctcaggaagtgtgacgttcgcaggaaatcatcatgggttatattttaataatatttcctcaggaactacaaaggaaggggctgtactttgttgccaagatcctcaagcaacggcacgtttttctgggttctccacgctctcttttattcagagccccggagatattaaagaacagggatgtctctattcaaaaaatgcacttatgctcttaaacaattatgtagtgcgttttgaacaaaaccaaagtaagactaaaggcggagctattagtggggcgaatgttactatagtaggcaactacgattccgtctctttctatcagaatgcagccacttttggaggtgctatccattcttcaggtcccctacagattgcagtaaatcaggcagagataagatttgcacaaaatactgccaagaatggttctggaggggctttgtactccgatggtgatattgatattgatcagaatgcttatgttctatttcgagaaaatgaggcattgactactgctataggtaagggaggggctgtctgttgtcttcccacttcaggaagtagtactccagttcctattgtgactttctctgacaataaacagttagtctttgaaagaaaccattccataatgggtggcggagccatttatgctaggaaacttagcatctcttcaggaggtcctactctatttatcaataatatatcatatgcaaattcgcaaaatttaggtggagctattgccattgatactggaggggagatcagtttatcagcagagaaaggaacaattacattccaaggaaaccggacgagcttaccgtttttgaatggcatccatcttttacaaaatgctaaattcctgaaattacaggcgagaaatggatactctatagaattttatgatcctattacttctgaagcagatgggtctacccaattgaatatcaacggagatcctaaaaataaagagtacacagggaccatactcttttctggagaaaagagtctagcaaacgatcctagggattttaaatctacaatccctcagaacgtcaacctgtctgcaggatacttagttattaaagagggggccgaagtcacagtttcaaaattcacgcagtctccaggatcgcatttagttttagatttaggaaccaaactgatagcctctaaggaagacattgccatcacaggcctcgcgatagatatagatagcttaagctcatcctcaacagcagctgttattaaagcaaacaccgcaaataaacagatatccgtgacggactctatagaacttatctcgcctactggcaatgcctatgaagatctcagaatgagaaattcacagacgttccctctgctctctttagagcctggagccgggggtagtgtgactgtaactgctggagatttcctaccggtaagtccccattatggttttcaaggcaattggaaattagcttggacaggaactggaaacaaagttggagaattcttctgggataaaataaattataagcctagacctgaaaaagaaggaaatttagttcctaatatcttgtgggggaatgctgtagatgtcagatccttaatgcaggttcaagagacccatgcatcgagcttacagacagatcgagggctgtggatcgatggaattgggaatttcttccatgtatctgcctccgaagacaatataaggtaccgtcataacagcggtggatatgttctatctgtaaataatgagatcacacctaagcactatacttcgatggcattttcccaactctttagtagagacaaggactatgcggtttccaacaacgaatacagaatgtatttaggatcgtatctctatcaatatacaacctccctagggaatattttccgttatgcttcgcgtaaccctaatgtaaacgtcgggattctctcaagaaggtttcttcaaaatcctcttatgatttttcattttttgtgtgcttatggtcatgccaccaatgatatgaaaacagactacgcaaatttccctatggtgaaaaacagctggagaaacaattgttgggctatagagtgcggagggagcatgcctctattggtatttgagaacggaagacttttccaaggtgccatcccatttatgaaactacaattagtttatgcttatcagggagatttcaaagagacgactgcagatggccgtagatttagtaatgggagtttaacatcgatttctgtacctctaggcatacgctttgagaagctggcactttctcaggatgtactctatgactttagtttctcctatattcctgatattttccgtaaggatccctcatgtgaagctgctctggtgattagcggagactcctggcttgttccggcagcacacgtatcaagacatgcttttgtagggagtggaacgggtcggtatcactttaacgactatactgagctcttatgtcgaggaagtatagaatgccgcccccatgctaggaattataatataaactgtggaagcaaatttcgtttttagaaggtttccattgcctgtgtggttccggatcttaactataaatcctggactatggatcataggcattgggtttctcgaacttgtgtggagaataacgacattttatatgcataacggaatactcgtatcacctcagcccctagagacattctttaggggttctttatttgtctaaacttcgtattttatcgagaatcctttacgttcttggtttgcttgtctccgaggagttctctaacgaatcatagggattccagggttctgttccttgagtcctttggcagctgatttgcgtctttctcaggagtagagcgtgtggtttcagggcttgggactcctagtaagacgagccattctgatagcctctctaggagagcgcttcgaagaggttcctgcaactgcttctaagtaaaaatctaaagagaagtctagttttttcgatacattgacttcttttttgaaaccagacactcattgctagccgaattttaagagtccatgagcatgatttctgtaaaatcctcgcaatgagctttttgtcttctcaccttatgatgtgctttctataagtatttaaatgaacttttattaaaagagttttcgctataacctttcgctcattttttcctttcttgtcgtgataccgctaactgatagcactacaagctctctttcaacgtctctcttagatgaaggaaacccacaatccatgaggaaacttcgtattcttgcgatcgttctcatagctttgagcattattttgattgcaggtggtgtggtattgcttactgtagcgatccctggattaagttcagtcatttcttccccggcagggatgggtgcctgtgctttgggatgtgtgatgcttgctttagggatcgatgttcttctgaagaaacgagaagtccctatagttctcgcatctgtaactacgacaccaggaactggcagccctagaagtggtatttctatttcaggagctgatagcaccatacgttctcttcctacgtatctcttggacgagggacatccacaatccatgaggaaacttcgtattcttgcgatcgttctcatagtttttagcattattttgattgcaagtggtgtggtattgcttactgtagcgatccctggattaagttcagtcatttcttccccggcagggatgggtgcctgtgctttgggatgtgtgatgcttgctttagggatcgatgttcttctgaagaaacgagaagtccctatagttctcgcatctgtaactacgacaccaggaactggcagccctagaagtggtatttctatttcaggagctgatagcaccatacgttctcttcctacgtatcccttggacgagggacatccacaatccatgaggaaacttcgtattcttgcgatcgttctcatagtttttagcattattttgattgcaagtggtgtggtattgcttactgtagcgatccctggattaagctcgatcatttcttccccagcggagatgggtgcttgtgctttgggatgtgtgatgcttgctttggggatcgacgttcttctgaagaaacgagaagtccctatagtagttcccgcacctattcctgaagaagtcgtcatagatgatatagatgaagagagtatacggctgcagcaggaagctgaagccgctttagcaagacttcctgaggagatgagtgcatttgaaggttacataaaagttgtcgagagtcatttggagaacatgaaaagcctgccttatgatggtcatgggctagaagagaaaacgaaacatcagataagagtcgtcagatcttctttgaaggctatggttccagaatttttagatatcagaagaatttttgaagaagaagagttcttttttctctcagctcgcaaacgacttatagatttagctactactttagtagagagaaaaattttaacagagcaacttgagcgcaataatttaaggaaagcgttttcttatttatatcaggactcaatttttaaaaaaattattgataacttcgagaagttagcatggaaatttatgattttgagtaaatcaatttgtcgatttacaattatttttgaaaatcatgaacatggtgtagcaaagagcctgttacacaagaatgcagtgttactggagaaggtaatctataggagtttgcaaaaaagctatagagatataggcatgtcatctgcaaagatgaaaatcttgcacggcaacccttttttctctttggaagataataaaaagacgataatgaaagaacacgcagagatgcttgaaagtctcagtagctataggaaggtatttttagctctatctgatgagaacgttgtagatacacctagcgatccaaagaaatgggatttgtcaggaatcccctgtagggacgcgttgtctgagatttctcgtgatgaacagtggcagaagaaagcacatctaaagcatcaagagtccctctatacgcaagctagggatcgtttaacagaccagagctctaaagaaaatcagaaagagttagagaaagctgaacaagagtacatatcttcttgggaacgggttaaaaaatttgagattgagagagtacaggagaggatacgggcaattcaaaagctttatcctaatatcctcgagagagaagaagaaaccacaggtcaggagactgtgactccaactgttcaagggacgacggcttcatccgatttaacagatattttaggaagaatagaggtctccagtagggaggataatcagaatcaagagtcttgtgtaaaagtcttaagaagtcatgaggtagaaatgagctgggaagtcaaacaagagtatggccctaagaaaaaagaatttcaggatcaaatgggttctttagagaggttttttacagagcatattgaagagttagaagtattacagaaggactactctaaacacttgtcttattttaaaaaagtaaacaataagaaagaggttcaatatgcgaagtttaggttgaaggttttagagtcagatttagaagggattctagctcagactgagagtgctgagagtctgttaactcaagaagaacttccgattcttgcaactcggggagccttagagaaagctgttttcaaagggagtctatgttgcgcgctagcaagcaaagcaaaaccctattttgaagaggatcccagattccaagattctgatacgcaattgcgagctctgactctaaggttacaggaggctaaggcaagcctggaagaagagataaagagattttcaaatcttgagaacgatattgcagaggaaagacgccttcttaaagagagcaagcagacgttcgaaagagcaggtttaggggttctccgagaaattgcagtcgagtctacttatgatttgcgttccttaacaaatacatgggaagggaccccagagagtgagaaggtctattttagcatgtatcttaattattacaacgaagagaaacgtagggctaaaacaagattggttgaaatgacacagaggtatagagattttaaaatggccttggaagctatgcagtttaatgaagaagcccttttgcaagaggaactctctattcaagctcccagtgaataacaagaatccgaggcaagagctcggcatgtcgctcgctataggctacgagttgcccaatctcgtttggctgatttagaagctggagtcatccagaaacgtaaaacaatcaaagatttgttcaagaaacgacggtctcaaccttcttctaagaaatagaaaatttcgtccatgcttccagggttttgaaatgagaaaaagaccttggaataaaataattgatatgagtagcttagttgctttaacttatgtttttgagcatgatgacatcacagattcataatgcaagtattcttatctcctcaactaccccccccccccccgacgctctctaggggtttcttgttctaaacttcgtagtttatcgatcactcttttagttcttggtgtgcttttgttgaccttggggattccgggactcactgcagggatctcttttggagccggtttgggattttctgctttaggaggagtgctcgtgatttcgggacttctattccttctagtaagacgagaggttccgacagtacgttcagaggaaattcccagaggggtttctgtgaccccttctgaagagcctgctctagagaaggctcaaaaagaaccggagacaaagaaaattttagatcggttgccgaaggaattggatcagttagatacgtatattcaggaagtgtttgcatgtttagagaggctgaaggatcctaagtacgaagatcgaggtcttttaacagaggcgaaggagaaacttcgagtttttgacgttgttgagaaagatatgatgtcagagtttttagacatacaacgagtgttgaatgaggaagcatattatgtagaacattgtcaagatcccctagagaatatagcctacgagattttctcttcccaagagcttcgtgattactactgtgcaggggtgtgtgggtatttgccttctggggatgctcgagcggatcgattaaagagatcagttaaggaggtaatggatcgctttatgagggtgacctggaaatcttgggaggcatcagtcatgttggatcatagctatggggtagcgcgagagttattcaagaaggcagtaggagtactagaggagagtgtctataaaattctgtttaagagctatagagatgcgttttatgaatgtgagaaggcaaagatccagagggatgggcgtttcaaatggttataggatacgagtgctcatgcggaacaaaggtttagggatatcaatggttgttgggaggacttaaagcaaacgatcttttgggtaggagaacatgattgtacggacatagagaccgtacgtaaaagctgtatgtggctggatcgttatgcagataaatttattttgagggaaaaagaggaaaagatggagcgtcatgagctctttcatgcgactatggtccgaaaagcatctgggcacgcgtatgctaaagctaaagcagcctttgaaaaggagagatctaatgagaatcagaggaaagtcaaggatgttgaaaaatggttatctaaaggtttagcggagtttcgtaatcaagagtctcgcagagctcgggagaggctgagagagctgcaaactttgtatcctgaggtttctgtagaagagagagtgttagagagacaaaggactaaaaaagttaatctggagaacttgtatgcagatatagaaaagaagtatcaccactgtgttcgagagcaagagcattactggaaagaggtagagaacaaggaagcagagtatagggagaacggagaaaaggttctctctgccgaggaggtgtcagagtgtcttcagaggttggaagattgtttagagacgtggtctaagaaattaacaaaagcggaagagagtgtctttgagatgaagtttgatgcgacagaaaaactagggaataaagtactttctgatgtaacgaaccgtcttgagattttatgtgaagatgctgaggagatgatttttcgaatcgaagagatagagatgactctgcgtatggtagagcttccactactttttatgaaaaatacttttgagaaagcctctctacaatacaacagctgcaaagagatgttagccaaagtagagccccaatgtaaggaaagcccaacctatagaagtagccaagagcgcttagaaaggttgaatcaggatttacaaacagcatatacaaattgccaggagagactccagggtttttcagatttggaatcaaaagtacgtacatgtagagatcatcttagagagcagatgaaacatttcgaagttcaaggactgaattttataaacgaagagcttttatgggtcggggcagagctctttacacaagccagattggatctagtagcaacagttccgtatatggagttctatttgcagtaccataatattaaaagagaaaaagttcgatcccaatggatggcgaagaccgagaggtatagagagattcggcaggcatttcaaggggtgatgaaggaagatttgttagcagaagatacgatcttgaaagaagaagattattggctgcttcgcgatgattggttgctgcgtgatgagaggaagaatagacaaagacgtttaatctgtaataagatagcagcagcgcaacagcgagtcaaaggcttctaacctgaagagatttaaaagatcctgaaagagaaaacacctcttgtggctagagtgcgttctttatttactcgcgaggaccatacctagcataaaactccaggagctgtgtttctttaaaattctttgaataaaatactatatattagtagcttagtgggtttaatttatgtgtttgatcgcgatggcaccacagattcataatgcaagtacttctatctccgcagctaccccccccccccccaacactctgtagggtcgatttcttctccatctaaacttcgcgttttagcgattacttttttagtttttggtatgctcttactgatttcaggagctctctttctgacgttagggattccaggattgagtgcagcaatttcttttggattaggcatcggtctctccgcattaggaggagtgctgatgatttcgggactactatgtcttttagtaaaacgagagattccgacagtacgaccagaagaaattcctgaaggggtttcgctggctccttctgaggagccagctctacaggcagctcagaagactttagctcagctgcctaaggaattggatcagttagatacagatattcaggaagtgttcgcatgtttaagaaagctgaaagattctaagtatgaaagtcgaagttttttaaacgatgctaagaaggagcttcgagtttttgactttgtggttgaggataccctctcggagattttcgagttgcggcagattgtggctcaagagggatgggatttaaactttttgatcaatgggggacgaagcctcatgatgactgcagaatctgaatcgcttgatttgtttcatgtatcgaagcggctagggtatttaccttctggggatgttcgaggggaggggttaaagaaatctgcgaaggagatagtcgctcgtttgatgagcttgcattgcgagattcacaaggtggcggtagcgtttgataggaattcctatgcgatggcagaaaaggcgtttgcgaaagcgttgggagctttagaagagagtgtgtatcggagtctgacgcagagttatagagataaatttttggagagcgagagggcgaagatcccatggaatgggcatataacctggttaagagatgatgcgaagagtgggtgtgctgaaaagaagctcgggatgccgaggaacgttggaagaaatttaggaaagcagtcttttgggtagaagaagacgggggctttgacatcaataatctccttggagactgggggacagtgcttgatccttatagacaagagagaatggacgagataacgttccatgagttgtatgaaaaaactacgtttttgaaaagactgcacagaaagtgtgcgttagcgaaaacaacctttgaaaagaagagatctaaaaagaatttgcaggcagtcgaggaggcgaatgcacgtaggttgaaatatgtaagggattggtatgatcaggagtttcagaaagcaggggagagattagagaaactgcatgctttgtatcctgaggtttcagtctctataagagagaacaaaatacaagagacgcgctctaatttagagaaagcctatgaggctatcgaagagaactatcgttgctgtgtccgagagcaagaggactactggaaagaagaagagaaaagggaagcggagtttagggagaggggaaacaagattctttctcctgaggagctggaaagttctttggagcaattcgaccatggtttgaaaaatttttctgagaaattaatggaattggaagggcatatcttaaaacttcagaaagaagccacagcagaggtggagaataaaatactttcagatgcagagagccgccttgagattgtatttgaagatgtcaaggagatgccctgtcgaattgaggagatagagaagacgctgcgtatggcggagctgcccctacttcctacgaagaaggcgtttgagaaggcctgctcacaatataatagctgcgcagagatgttggagaaggtgaagccttactgcaaggagagcctcgcctatgtgactagcaaagagcgtttagtgagcttggatgaagatttacgacgagcctacacagagtgtcagaagagattccagggggattcgggtttggagtcggaagtaagagcctgtcgagagcaactgcgagagcggatccaagagtttgaaactcaagggctggacttggtggaaaaagagttgctttgtgtgagtagtagattaagaaatacagagtgcgattgtgtatctggtgttaagaaagaagcacctcctggtaagaagttttatgcccagtattatgatgagatttatcgagttagagttcaatcccgatggatgacgatgtctgagagattgagagagggagttcaagcatgcaacaagatgttgaaggcaggcctaagcgaagaagataaggttcttaaagaagaagagtattggttgtatcgagaggagagaaagaataaagagaaacgtttggttggtactaagatagtagcaacgcagcagcggatccaagaatttcaaccatctgatatcgttgagtcttcaaatgagaaagtgagccttatggacaaagcgcgatttttatttaatcgtgaggaccattcctagaactattctaggagtctatgtgcactattttttaagaggtttattattccgtgggtatgtctgagagactttgattaaatgggatattattatatcctagttgctctaatcaatattcctcttatgattttggtattcgatcatgactgcagcaccagctattctacacgtatccccgacaccccctgaagaaacaaaattcgttattcctaaagatagtaaatctcgcgctcttgggattactttattagtcgtaggcatccttctggtagtttgtggtgcgattgtactcagtggagtgatttctggattgagtgcactcattgtttgtggattgggtattagtacgatttctctaggagttgtcctatttgttttaggattgatattattacttagaaagcgggaacttaccttagaacagatcgaggctaagcaaattgcggagacctttgctgatgaactgaaagaactagaaatgtacattcagtcgacagagaaaagcttagagaagatagaagggtcccgttatagtgaccaaggttttctgaatcgtgccacccaaaaaatcttagatttagaatcttcattgagctctattacttctgagtttcgtgatcttaggcaactctttgatgaagaaaaaatagagttactttctggagaaaggcttttagaatttattgcagcgaatttatttaaacaaggaagagatgtctatttaaatttagggaatttagcagacattcgtgcgtacatggggcccaacaattataaagttgcgatggtcatagaaaaagctaaagcagttgtgcatgagtttatagttctgactacaatggctagggaattagagttttttttctaaaaaataaatatggtttattaaaggggatgtaccaggagaatctaagattgttggaaaggcttctttataatagtgttcaaaagagctatgcggatcggctgttttcctatgaaaagacaaagatggtgcacgatactccgctgattccttgggaagaggataaggaaaaatgtgctgaagctgagaaagctttcttagagcaacagaagattctcctagattatggaaaatctatcttttggctgaatgagaacgatgagatcaatttaaacgatccttggagttggggtcttaatacggtgaggactaggaaagtattccaagaggttgacgacagtgaacgttggaatcataaggtactcattcaaaaactcgaggacgattatgagaaacttctagaggaaagttcaaaagagtctactgaagcaaataagaagcttttatctgacttagtagatcgtcttgaagatgctaagacaaaatttttcctgaagaaacaggaggaggtggagactcgcgttaaggatcttagagctcgatatggaggcacagtagatcctaagcaggatacggaagctaagaagaaagtcgaattggaggctagcttagaaacctttttagattccatcgaatcagagctagtacagtgtttagaagatcaagatatatattggaaagaacaggatgtcaaagatctagcacgtacgcaagagctcgaggaacaagatattgaagcgaagagggaagaagctgccgaagacctaagaagtcttaatgagcgtttaaagaagtcaaaaactatgttagatagggctaaatggcatattgaaaatgctgaggacagtattacctggtggactagtcagatagaaatgaaggatatgaaagcaagactgaagatcttaaaagaagatataacaagtgttctacctgaaatagatgagattgaaacgtgtttaagcttagaggagcttcctttgcttacgaccagggaactcttaactaagtcctacctaaagtttaagatttgttcggaaacactattaaaaatgacttctgtgtttgagaacaatatctatgttcaggagtacgaggttcagctgcaaaatctagggtttaagttacaaggtatatctcagagattcggaaagaaacaagacgattttgcgaatctagaggaacaggttgctttgcaaaagaaacgactcagagagctcactcagaattttgaaatacaaggattcaatttcatgaaagaagattttaaggcagccgctaaagatctttatataagaagtacagctgaacaaaagatgaactttgatgtgccttgcatggagctcttccgtaggtatcatgaggaggtcaacaagccgcttcttgagttgatgtacaattgtgcagacagttatagagatgctaagaaaaagctttgctctctacgtcttgatgaaaaagagttattacaaaaagaaatcaagaaagaggaattttatcaaaagaaacaacaaaggcatgcagatagatcacgtcatactacgtatcaaaagctacgaattgctgaagagcttgctcttgagctgaagaagaaaatctaatcactaaagcctagttaagggttcttttgaattgggccctgtgtttccatttctctagggatcctcttagctgaggatcttctttgtacctcttttgattcgaaaagaggtgctattgtgagttgccaatagcaacgatccaccttcgtttttgaaaagatacatcagttgctaagggaacttttcagaaaatatcataaaaaactcccaagattttggcttggaaagcgagcctttcttgctacttttgttacaacaaaagtgttctattttaacgtgcgtatcatttgtgactaagagatagacttgctttctttatctatcttctgtattggaaagaaagccccttgagggaaaaaaaggttgttatgaagattccactccgctttttattgatatcattagtacctacgctttctatgtcgaatttattaggagctgctactaccgaagagttatcggctagcaatagcttcgatggaactacatcaacaacaagcttttctagtaaaacatcatcggctacagatggcaccaattatgtttttaaagattctgtagttatagaaaatgtacccaaaacaggggaaactcagtctactagttgttttaaaaatgacgctgcagctggagatctaaatttcttaggagggggattttctttcacatttagcaatatcgatgcaaccacggcttctggagctgctattggaagtgaagcagctaataagacagtcacgttatcaggattttcggcactttcttttcttaaatccccagcaagtacagtgactaatggattgggagctatcaatgttaaagggaatttaagcctattggataatgataaggtattgattcaggacaatttctcaacaggagatggcggagcaattaattgtgcaggctccttgaagatcgcaaacaataagtccctttcttttattggaaatagttcttcaacacgtggcggagcgattcataccaaaaacctcacactatcttctggtggggaaactctatttcaggggaatacagcgcctacggctgctggtaaaggaggtgctatcgcgattgcagactctggcaccctatccatttctggagacagtggcgacattatctttgaaggcaatacgataggagctacaggaaccgtctctcatagtgctattgatttaggaactagcgctaagataactgcgttacgtgctgcgcaaggacatacgatatacttttatgatccgattactgtaacaggatcgacatctgttgctgatgctctcaatattaatagccctgatactggagataacaaagagtatacgggaaccatagtcttttctggagagaagctcacggaggcagaagctaaagatgagaagaaccgcacttctaaattacttcaaaatgttgcttttaaaaatgggactgtagttttaaaaggtgatgtcgttttaagtgcgaacggtttctctcaggatgcaaactctaagttgattatggatttagggacgtcgttggttgcaaacaccgaaagtatcgagttaacgaatttggaaattaatatagactctctcaggaacgggaaaaagataaaactcagtgctgccacagctcagaaagatattcgtatagatcgtcctgttgtactggcaattagcgatgagagtttttatcaaaatggctttttgaatgaggaccattcctatgatgggattcttgagttagatgctgggaaagacatcgtgatttctgcagattctcgcagtatagatgctgtacaatctccgtatggctatcagggaaagtggacgatcaattggtctactgatgataagaaagctacggtttcttgggcgaagcagagttttaatcccactgctgagcaggaggctccgttagttcctaatcttctttggggttcttttatagatgttcgttccttccagaattttatagagctaggtactgaaggtgctccttacgaaaagagattttgggttgcaggcatttccaatgttttgcataggagcggtcgtgaaaatcaaaggaaattccgtcatgtgagtggaggtgctgtagtaggtgctagcacgaggatgccgggtggtgataccttgtctctgggttttgctcagctctttgcgcgtgacaaagactactttatgaataccaatttcgcaaagacctacgcaggatctttacgtttgcagcacgatgcttccctatactctgtggtgagtatccttttaggagagggaggactccgcgagatcctgttgccttatgtttccaagactctgccgtgctctttctatgggcagcttagctacggccatacggatcatcgcatgaagaccgagtctctaccccccccccccccgacgctctcgacggatcatacttcttggggaggatatgtctgggctggagagctgggaactcgagttgctgttgaaaataccagcggcagaggatttttccaagagtacactccatttgtaaaagtccaagctgtttacgctcgccaagatagctttgtagaactaggagctatcagtcgtgattttagtgattcgcatctttataaccttgcgattcctcttggaatcaagttagagaaacggtttgcagagcaatattatcatgttgtagcgatgtattctccagatgtttgtcgtagtaaccccaaatgtacgactaccctactttccaaccaagggagttggaagaccaaaggttcgaacttagcaagacaggctggtattgttcaggcctcaggttttcgatctttgggagctgcagcagagcttttcgggaactttggctttgaatggcggggatcttctcgtagctataatgtagatgcgggtagcaaaatcaaattttagcgatttctctttcgatgctatttttccatggctatttttaaaatgatagccatggttatagatacgtagtccttatttcaaagaagacactgttgcattagatacgctctctgatccctcaaaatcacattttggtatctgattgctaagattgcaggataccacgcatcttaagagaaaggcgctcttacctagtagaggttgagtgaatttcttgacttgtttctcctattggtgtatctcttaaaatattaaattcaaaatcaaagtatatattttacaatgaagtcttctttccccaagtttgtattttctacatttgctattttccctttgtctatgattgctaccgagacagttttggattcaagtgcgagtttcgatgggaataaaaatggtaatttttcagttcgtgagagtcaggaagatgctggaactacctacctatttaagggaaatgtcactctagaaaatattcctggaacaggcacagcaatcacaaaaagctgttttaacaacactaagggcgatttgactttcacaggtaacgggaactctctattgttccaaacggtggatgcagggactgtagcaggggctgctgttaacagcagcgtggtagataaatctaccacgtttatagggttttcttcgctatcttttattgcgtctcctggaagttcgataactaccggcaaaggagccgttagctgctctacgggtagcttgagtttgacaaaaatgtcagtttgctcttcagcaaaaacttttcaacggataatggcggtgctatcaccgcaaaaactctttcattaacagggactacaatgtcagctctgttttctgaaaatacctcctcaaagaaaggcggagccattcagacttccgatgcccttaccattactggaaaccaaggggaagtctctttttctgacaatacttcttcggattctggagctgcaatttttacagaagcctcggtgactatttctaataatgctaaagtttcctttattgacaataaggtcacaggagcgagctcctcaacaacgggggatatgtcaggaggtgctatctgtgcttataaaactagtacagatactaaggtcaccctcactggaaatcagatgttactcttcagcaacaatacatcgacaacagcgggaggagctatctatgtgaaaaagctcgaactggcttccggaggacttaccctattcagtagaaatagtgtcaatggaggtacagctcctaaaggtggagccatagctatcgaagatagtggggaattgagtttatccgccgatagtggtgacattgtctttttagggaatacagtcacttctactactcctgggacgaatagaagtagtatcgacttaggaacgagtgcaaagatgacagctttgcgttctgctgctggtagagccatctacttctatgatcccataactacaggatcatccacaacagttacagatgtcttaaaagttaatgagactccggcagattctgcactacaatatacagggaacatcatcttcacaggagaaaagttatcagagacagaggccgcagattctaaaaatcttacttcgaagctactacagcctgtaactctttcaggaggtactctatctttaaaacatggagtgactctgcagactcaggcattcactcaacaggcagattctcgtctcgaaatggacgtaggaactactctagaacctgctgatactagcaccataaacaatttggtcattaacatcagttctatagacggtgcaaagaaggcaaaaatagaaaccaaagctacgtcaaaaaatctgactttatctggaaccatcactttattggacccgacgggcacgttttatgaaaatcatagtttaagaaatcctcagtcctacgacatcttagagctcaaagcttctggaactgtaacaagcaccgcagtgactccagatcctataatgggtgagaaattccattacggctatcagggaacttggggcccaattgtttgggggacaggggcttctacgactgcaaccttcaactggactaaaactggctatattcctaatcccgagcgtatcggctctttagtccctaatagcttatggaatgcatttatagatattagctctctccattatcttatggagactgcaaacgaagggttgcagggagaccgtgctttttggtgtgctggattatctaacttcttccataaggatagtacaaaaacacgacgcgggtttcgccatttgagtggcggttatgtcataggaggaaacctacatacttgttcagataagattcttagtgctgcattttgtcagctctttggaagagatagagactactttgtagctaagaatcaaggtacagtctacggaggaactctctattaccagcacaacgaaacctatatctctcttccttgcaaactacggccttgttcgttgtcttatgttcctacagagattcctgttctcttttcaggaaaccttagctacacccatacggataacgatctgaaaaccaagtatacaacatatcctactgttaaaggaagctgggggaatgatagtttcgctttagaattcggtggaagagctccgatttgcttagatgaaagtgctctatttgagcagtacatgcccttcatgaaattgcagtttgtctatgcacatcaggaaggttttaaagaacagggaacagaagctcgtgaatttggaagtagccgtcttgtgaatcttgccttacctatcgggatccgatttgataaggaatcagactgccaagatgcaacgtacaatctaactcttggttatactgtggatcttgttcgtagtaaccccgactgtacgacaacactgcgaattagcggtgattcttggaaaaccttcggtacgaatttggcaagacaagctttagtccttcgtgcagggaaccatttttgctttaactcaaattttgaagcctttagccaattttcttttgaattgcgtgggtcatctcgcaattacaatgtagacttaggagcaaaataccaattctaatgcgttagctttggtaaagagctccatacatcgaagggaaaagagcttttaagatttcttgaaggctcttttcgatttcgatttccattttagtgttttgctaaaacactttctaatttttttcttttgttttctacattgaaaaaaagagagttacggcagctgtaaagtttttaatattgctccctttgttccatttatgtagcgttcagactttgcactaaaacgagggtgtcatatgagatcgtctttttccttgttattaatatcttcatctctagcctttcctctcttaatgagtgtttctgcagatgctgccgatctcacattagggagtcgtgacagttataatggtgatacaagcaccacagaatttactcctaaagcggcaacttctgatgctagtggcacgacctatattctcgatggggatgtctcgataagccaagcagggaaacaaacgagcttaaccacaagttgtttttctaacactgcaggaaatcttaccttcttagggaacggattttctcttcattttgacaatattatttcgtctactgttgcaggtgttgttgttagcaatacagcagcttctgggattacgaaattctcaggattttcaactcttcggatgcttgcagctcctaggaccacaggtaaaggagccattaaaattaccgatggtctggtgtttgagagtatagggaatcttgatcttaatgaaaatgcctctagtgaaaatgggggagccatcaatacgaagactttgtctttgactgggagtacgcggtttgtagcgttccttggcaatagctcgtcgcaacaagggggagcgatctatgcttctggtgactctgtgatttctgagaatgcaggaatcttgagcttcggaaacaacagtgcgacaacatcaggaggcgcgatctctgctgaagggaaccttgtgatctccaataaccaaaatatctttttcgatggctgcaaagcaactacaaatggcggagctattgattgtaacaaagcaggggcgaacccagaccctatcttgactctttcaggaaatgagagcctgcattttctgaataacacagcaggaaatagtggaggtgcgatttataccaaaaaattggtgttatcctcaggacgaggaggagtgttattttctaacaacaaagctgcgaatgctactcctaaaggaggggcaattgcgattctagattctggagagattagcatttctgcagatctcggcaatatcattttcgagggcaatactacgagcactacaggaagtcctgcgagtgtgaccagaaatgctatagatcttgcatcgaatgcaaaatttttaaatctccgagcgactcggggaaataaagttattttctatgatcctatcacgagctcaggagctactgataagctctctttgaataaagctgacgcaggatctggaaatacctatgaaggctacatcgttttctctggagagaaactctcagaagaggaacttaagaaacctgacaatctgaagtctacatttacacaggctgtagagcttgctgcaggtgccttagtattgaaagatggagtgactgtagttgcaaatactataacgcaggtcgagggatcgaaagtcgttatggatggagggactacttttgaggcaagcgctgagggggtcactctcaatggcctagccattaatatagattccttagatgggacaaataaagctatcattaaggcgacggcagcaagtaaggatgttgccttatcagggcctatcatgcttgtagatgctcaggggaactattatgagcatcataatctcagtcaacagcaggtctttcctttaatagagctttctgcacaaggaacgatgactactacagatatccccgataccccaattctaaatactacgaatcactatgggtatcaagggaactggaataattgtttgggtcgacgatgcaactgcaaaaacaaaaaatgctaccttaacttggactaaaacaggatacaagccgaatccagaacgtcagggacctttggttcctaatagcctgtggggttcttttgtcgatgtccgctccattcagagcctcatggaccggagcacaagttcgttatcttcgtcaacaaatttgtgggtatcaggaatcgcggactttttgcatgaagatcagaaaggaaaccaacgtagttatcgtcattctagcgcgggttatgcattaggaggaggattcttcacggcttctgaaaatttctttaattttgctttttgtcagctttttggctacgacaaggaccatcttgtggctaagaaccatacccatgtatatgcaggggcaatgagttaccgacacctcggagagtctaagaccctcgctaagattttgtcaggaaattctgactccctaccttttgtcttcaatgctcggtttgcttatggccataccgacaataacatgaccacaaagtacactggctattctcctgttaagggaagctggggaaatgatgccttcggtatagaatgtggaggagctatcccggtagttgcttcaggacgtcggtcttgggtggatacccacacgccatttctaaacctagagatgatctatgcacatcagaatgactttaaggaaaacggcacagaaggccgttctttccaaagtgaagacctcttcaatctagcggttcctgtagggataaaatttgagaaattctccgataagtctacgtatgatctctccatagcttacgttcccgatgtgattcgtaatgatccaggctgcacgacaactcttatggtttctggggattcttggtcgacatgtggtacaagcttgtctagacaagctcttcttgtacgtgctggaaatcatcatgcctttgcttcaaactttgaagttttcagtcagtttgaagtcgagttgcgaggttcttctcgtagctatgctatcgatcttggaggaagattcggattttaatcctaagttttccaacgagatagcatcagggtaagccagggctctatgtaagagatttcatagagccctctctttgtcttgctttttgtattttatttttatatttcgtgaatccgttgttccaatgttcgaaaggtatcctagatgagattgctgttgtcttgtcctatgctttttatagctgcatgtgcctcattttttggctttcaggaagaaatgcaaggcagaaatatacaatctcttgatgcaaatgcttctagtctaggggaacttttttctatttctacgaagggagtgtcttgtctagaactccatagggagatcgcacgctaaatatgagaatataatatgaagacttcagtttctatgttgttggccctgctttgctcgggggctagctctattgtactccatgccgcaaccactccactaaatcctgaagatgggtttattggggagggcaatacaaatactttttctccgaaatctacaacggatgctgcaggaactacctactctctcacaggagaggttctgtatatagatccggggaaaggtggttcaattacaggaacttgctttgtagaaactgctggcgatcttacatttttaggtaatggaaataccctaaagttcctgtcggtagatgcaggtgctaatatcgcggttgctcatgtacaaggaagtaagaatttaagcttcacagatttcctttctctggtgatcacagaatctccaaaatccgctgttactacaggaaaaggtagcctagtcagtttaggtgcagtccaactgcaagatataaacactctagttcttacaagcaatgcctctgtcgaagatggtggcgtgattaaaggaaactcctgcttgattcagggaatcaaaaatagtgcgatttttggacaaaatacatcttcgaaaaaaggaggggcgatctccacgactcaaggacttaccatagagaataacttagggacgctaaagttcaatgaaaacaaagcagtgacctcaggaggcgccttagatttaggagccgcgtctacattcactgcgaaccatgagttgatattttcacaaaataagacttctgggaatgctgcaaatggcggagccataaattgctcaggggaccttacatttactgataacacttctttgttacttcaagaaaatagcacaatgcaggatggtggagctttgtgtagcacaggaaccataagcattaccggtagtgattctatcaatgtgataggaaatacttcaggacaaaaaggaggagcgatttctgcagcttctctcaagattttgggagggcagggaggcgctctcttttctaataacgtagtgactcatgccacccctctaggaggtgccatttttatcaacacaggaggatccttgcagctcttcactcaaggaggggatatcgtattcgaggggaatcaggtcactacaacagctccaaatgctaccactaagagaaatgtaattcacctcgagagcaccgcgaagtggacgggacttgctgcaagtcaaggtaacgctatctatttctatgatcccattaccaccaacgatacgggagcaagcgataacttacgtatcaatgaggtcagtgcaaatcaaaagctctcgggatctatagtattttctggagagagattgtcgacagcagaagctatagctgaaaatcttacttcgaggatcaaccagcctgtcactttagtagaggggagcttagtacttaaacagggagtgaccttgatcacacaaggattctcgcaggagccagaatccacgcttcttttggatctggggacctcattataagcttctacagaagatattgtcatcacaaatttatctataaatgccgataccatttacggaaagaatcctatcaatattgtagcttcagcagcgaataagaacattaccctaacaggaaccttagcacttgtaaatgcagatggagctttctatgagaaccataccttgcaagactctcaagactatagctttgtaaagttatctccaggagcgggagggactataattactcaagatgcttctcagaagcctcttgaagtagctccttctagaccacattatggctatcaaggacattggaatgtgcaagtcatcccaggaacgggaactcaaccgagccaggcaaatttagaatgggtgcggacaggataccttccgaatcccgaacggcaaggatctttagttcccaatagcctgtggggttcttttgttgatcagcgtgctatccaagaaatcatggtaaatagtagccaaatcttatgtcaggaacggggagtctggggagctggaattgctaatttcctacatagagataaaattaatgagcacggctatcgccatagcggtgtcggttatcttgtgggagttggcactcatgctttttctgatgctacgataaatgcggctttttgccagctcttcagtagagataaagactacgtagtatccaaaaatcatggaactagctactcaggggtcgtatttcttgaggataccctagagtttagaagtccacagggattctatactgatagctcctcagaagcttgctgtaaccaagtcgtcactatagatatgcagttgtcttacagccatagaaataatgatatgaaaaccaaatacacgacatatccagaagctcagggatcttgggcaaatgatgtttttggtcttgagtttggagcgactacatactactaccctaacagtacttttttatttgattactactctccgtttctcaggctgcagtgcacctatgctcaccaggaagacttcaaagagacaggaggtgaggttcgtcactttactagcggagatcttttcaatttagcagttcctattggcgtgaagtttgagagattttcagactgtaaaaggggatcttatgaacttacccttgcttatgttcctgatgtgattcgcaaagatcccaagagcacggcaacattggctagtggagctacgtggagcacccacggaaacaatctctccagacaaggattacaactgcgtttagggaaccactgtctcataaatcctggaattgaggtgttcagtcacggagctattgaattgcggggatcctctcgtaattataacatcaatctcgggggtaaataccgattttaatagggaactgagagttccttattgtagagagtatttacaaggattttgagacgaaagagatttcttgttgtaggtatctctccacagggtctagttcaatttctatagttcatggggtttctttttttataaagaagaaaccccatgtctgacgagacctcacctggatctattgcattctctatggtaagggatccatgacttgacacaggaggttcattctcatgtctaagtcagaggttagaagggaggttttttaggtttgtcgagctttaagaagaagaaaaatcgactatctgcttctcggcgttcatacaccccatagagctgccaatgttcgaagatcttcgtccctagaatcatctggtattctaggtagttcggagtgtcctggcgatgccagccatagcgtaaggataagcggtaattccaacagggatgaggtcgtacaaataatttccctaaaatgagattcctatgatcagagagaggggagtctaaaagctggtcaatgggacggctgacatctaaaatgaagttctccctgtcacacttaatcaggctgtatttgcttctatgcagggattctagagtcatagccacattgtcatttccgatccactcccaacgtatgttcatgtgatcccaacagtgctttttccaaatccattcagcatctaaggagactgtatttttctttccaaaaggtagagatagctcgcatgcagttttgggaaacgtgggtttgctttctgtattgctcaagatgtgggtagtccacagcttcgcatggattctcgggaatcgagggttagtcttactcagtaccgaggtatctatacccgctttcagaaggtttaaggagtgaaaggcatcttgaatagaaaagatataatgatcttcattcttagctagaggacgagtctctgtaatgaaggtaacgaacggctctataatatggcgtctttgaatgtaggacttatgtaatagaaagcgataatcaagttgtagcttcgcggaaagctgactatggcgcgaggagatctcaggaacatcgctatagtaaatcagagaactccctagggtggaggagagcgttcctataggtagaggcacagttttatggagcttagggcgcgcagcaagacgtagtgaagagaaattctcgccaacgatatgatcgctaaaagcaaagtttaaatacccacattctacgatgttttcaaggtacactcccgtattataaatagaaatcgggtactgccttaatgttaaataagggagctcttggttggcattttggaaagagtttaccttaacagaagaggtgagatacccttcaaaatagttgtcattccaagtgcaatcgacacgtgtggggcctgtatttttcaacatgaagttgttggggaaaatgtcagcaacagtttcccaactatcgctgagatggtattctccagaaaaatttacatgcttatgcgtgaagcagaaatctccgtgtaggcgatagcgatcatgagcttctgccatatcgatagcaaggcggtgggcataatagcttttcatattgaagacattctcaggaacctgcttctgagaacaatggaggttgaatcccatgccgacgccatgcttgaaaaagctatccaagaaaaatgtcgaggagaaatgcttcctagaaatcggcgagtagctcatccccaaataggatcccagaaatcctcctgttcctcctcgaaagtttatcggaggcttagggatctccataggcatgatagaaaatggaggtaagaaaagtatcggaatgcgacacacccttaatgttgtcttccctatagaaagaagactatctgaagaatattccaggtaatctccggagaggcacaggtcttttttgggaccctcggaggtagagatatatcccttccgaatgactatggtttctggggttagagtgatcatagacccccctagaaaccaaggatacatcgcgaatcttccattagtaagaagacaagagtctgtatcttcgtaatactctaggtaatcacaaactagggtttttgccctatagttcaccataacattgccatgtgcgacaagcttcaggctttgacccacagtattttctacatacactttattggcttgtatccgcaggttgttatggatattcaataccccatcttcgatggtcacaatcccagaaacactcttaaagtgactaagataggagtttttctttttcacagcctcttgatgagtcaaagcatcagctgaggaacccataagaacaaaggaagctagaaataagaagcaacgtttcataagacgtaggttggggttactccacaatttttatgagtaagcctgcaaggactgggaaattttttgcatctccttccgtcatcagttgtatcaataaacggatatcttcggaagacttcgaggtggctagtgtctctagaatatccaacatgagcttcgtacggctttctggggtgacctgataacgtagatagggcatgctgggatggggtctttggttttccgtgtccacaaataacaaggtttcctgaattagcttttttgcataatcatggagagaacgttttttttcaggatctttggtgagattataaatagcaagatctgcataggcgcggatgataggttctccaggaagcttcgcagcttggaaaagtagatctaaggcttcctgatgtgaggtgtgacttaaaaaagaaatcgcagtagtggcaagctgagttttctgactcgccaaaagcttataaatacaggggaggtaagcttctttaggtaggcggaagagaaacgtaaggatctgctcttcaagacctcgggttgtggagagcaacctttccctctcctggggatcttgagggactatgatgttcacccgcttccaattttgtaaagtacgccccttagagaaactcaaggctagagtctcattataatgtggttggacaagcctttcggtaatgtattccagtagtttaggggtgtcacaccctaactctaagagagctaaagctacattcaacttggcttcgctgttcttagtttttaggaatatcggcagggcaatcggaatccctatctcagagggtagatgccgtaaggcatacagggctcgaggccgctcctcaagtgcttgcttttttatcacgggaagagcgtcctcttctttccccaaagcaattaaagcttgagctgctgctaaagtgacatccacatcaggcttctgcaattgcttttttatattgtagtagctctgaccatccttaagcttccctaaagcataaagaatagcttcttgatcttgaggagacgcactcgttagcaaattcctaagtgtcggaagaaagcgtttttgttggtattctccgatctgcaaagctgtggcactccgaatcgcgcttttcttggcagctaagagatcccgaatataagcatcagattcttcagtctccaagcgtaggaatattgccgcagataggcattggatttcttcgggaagcttatgaatgaaagaatgtagatgatcaatgactttagtgttcttcaaattagcaagtctataggcggcttctaagcggatgacaggatagggagatgctaaagctttaaacagtaagtcgtcagaagttttcccaagatgtcctgagactgccgataaaaccagtagctgctgcagggggtctgcagtttccatagcttgggagagcacgtccaaggcttctgaagatcccgccaggcctgctccaatgatggtgctttttctagtttgcggatctgaggagtggatgctttgcttgagatagtcttctccgatttttcttaaaacgaagaagtcatgatcaccgtaggcatctagagcttccagatatgttgctaaggcctgctgtgtagattgcgtacttatataaaggatcttatgacctacagactcagggaatttagcaacaagagaaatgggaagactacacaataaaagtccaaagagagttagatggaatagtcccatagatcgatgttcaactcctctagcaagtatttcaatgtttggatagggagaccttgaacattataaacacatccatggacctttttcaaaatcaagccaccatggcaaacgtcataagcgccacaattatttaatgttcctacagtgtcgatataagactctatgcggtgatcaggaatcatagtaagtgaaatctgagaagtctctgaccctgtgaggagttttcccttatgtaatacggcaatactcgtgaccacatcatgcgtctgattcctcaaggtctttaacatctggatagcgtctgctttgtcttgaggttttgtgaaaatacggccatcgtaagaaacaatagtatcgccagtgaggataatacagtcacaaggcgaatgtagctcagaaactgcataggccttttgtgcggcaagttcttgtgtataggctataggatccccagagtagctgactttactctcatcaaaatttgaaggaatgacagtaaagggaacacgaaatttttctaaaataaattttcttcttggcgaagaagaccctaaaactaaaggaagggacatagaataaaagctcctcgtgttagatacattacaacaattgcttatgacctgcagtatagtctaccatagttccatcgaagaatgtaatcttatctttatcaaagatcaataacttcgtagcacaatcttgaatcagtcctctgtcgtgagagacaaaaatcgctgtgcccttatagtcattgatagcccaagaaagagcagacacagactctaagtctaagtggttgttcgcttcatcaaggataaggacattatggttttctagcatcatccccgccatgagaagacgagctgtttctcctccagataatgcttggatttgcttgaaagcatcatcgcctccaaaaagcattttccctaacacactgcggatttcttgatcgttaattccggttttgcgattgcgtagccactcaaatagcgtttcttgaccacaatcagctagaacatcgctgtggttttgaggaaaatatgaacagatagcttgatggcctaacttgatacttcctgaagaaggagcctcaacacctgcaagtaacttcattaatgtagttttacccaatccattgttcccgataataccaagcttgtctccttgataaatctctaaagaaaaaggatggattacctgatgatccccataatcctttgtaatcgcttctaaagacaaaacgactttccctgaggatttgtcagatagggggaaacgaatgtaaggacgttggatattggatttttttaattcttgtggctgaagcttcttaatctctcttaatcgagactgcacttgactcgctcgtgatcccgcaccaaatttagcaacaaattccttaagctgagaaattttcttttccttagatttgatgtcggccttttcttgctcgcgagacgcggttttcatctctaccatatcgtcatagtttccagggtagataatgatcgtgtcgtaatcaatgtcagcaatgtgagtcgtaattgtatttaagaaatgacggtcgtgactgactacaatgacagtgccttcataatcttttaaaaagtttcccagccaattaatggaatagaggtccaagtggtttgttggctcatcaagaagaagtgcttcggggtgaccaaagagagcctggcaaagaagaactcgaaattgtaggtctatgggaatcatagccattttcttatcaaacatctcattggggatgccaatgcctgtgaggagttcttcggcttctgaatctgctcggtacccattttcctcgccgatgatctcttcaatttcaccaagctccattccaatggcgtcagtaaattcttgtagatagagattatcacggcgttgtaaagcttcccaaagacgagtatttcccataatgacacaatctaagactgttgtgtcgtgaaagctatcgatattttgacgcaggatccccacttttttaggtaaggaaatcgaacctcttgtaggttctatcattcccataatgatttttaaaagggtggactttcctgcgccgttaggaccagtaagaccgtagcagttcccggggttgaaaacgacggaaacatcatcgaataaaattcgagtgcctaaagatttgccaattttatctaatactatgctcatagcagacagcataacaaagtgctgcttagagtacaagagctttgccctgttctcttaggcatggggatgggcttcttggtgggtctgtttttttaactttacagagacttgcgtatagaccgttgttgtctctaaagaactatgaccaagaagtgcttggattgtttttaaatccataccactctctagccaatgggtggctatagtgtgacggattgtatggggggtgatgtgccctgaaagtccagaacgtcgaagatattcttgaaaacttctgtcaatagatcgtgttgaaatgcgcctcccaaagcgattgagaaagatggcttgaggatccttttccaaacgctttctatccggatggttcaggtagatttggatccattgtatggcattcgatgtcacgggaataatcctttcttttttccctttcccacggatgcgaatcagatgagtactcaaatcaaagtcctgtttattaacagcgacaatctcactaatcctcaaacccgaactatagaacagctccatgagacagcgatcacgaagtccgtgatatttagaaatgtcaggagtcgccatcagcacttcaacttgcgcataggtcatcggggaaggcagctccttaggaagacgaggtccgtggatagtttccgcaggattttccaaaagaatcttttgaataacacagtaatgggcaaagcttttaatggaagagaggcaacgcttaattgttctcttagctttgccattttctatcagtttcgcgatgtacatgcgtacatgctctttggtgaataaggaaaaaggaagttcagagactttgcgcttctctgtggctaactgtaaaggagaagaaggagcgaggttaccacgttcctctaaaaaaattttcaatccattaagatctagacaataatttcttaatgtatgcggagaggcactttttaccattttcaaatagtctaagaacgaatagatagaggcaatcataacttctctttaccttacaataaagatcgtaaaaagacttcctcttagctttaggaaggctagcttcttactattctttccgagctatttatttagaagaggatttttcggaaaggggtagctgcgatattcttgtgctacggacacattaggaaatactgccgaggcttctttataaaaatcatccagatttaagtaacgtgccgagaagtgtgtgagaataagcttttgtgttgcggcacgtttcgcaagagtcgccgcttgttttgcagtcatatgaaaatggctctcagcaagatggcggtgctgttcgaggtaggtgctttcacacaacatcatgcagctattttttgcgagatctatagcagcttggcaaggcaaagtatccgcaataatcgcaatgctatcccccttgcggacgtagctaacatcactaagatataccgtagaaccgcctatcgaaatttcttggtcacgaataagatcttggataatcagaccacgaatgcctcgagattccagctctttaggaagaaattttatagtgtctggttccgtgattctccatcctaaagtgtctacttggtgttggagtcgctgtgcttcaatacgaaaactaccaaaatcttcgacaattccttcctcagagattggatgctccaccacctggatggtttcgtgataaattgttccataacgtaagcggtcaaagtattttttccctgaagcaggatagtagcaatggatagggtgcgaaaccttgtccaagttaagacgcatcaacatggagcctagacccaaacaatgatctccatggaaatgactcacaaaaattctattgactgttgtaggagcaatatttgcaaagatgaattgcctttgagtgccttcaccaggatcaaaaagtagaccctcaccattccagcgaaataggtaggctccttgattgcgtgttcgtgtaggctgttggctcgagcaccctaaaataattaactctctagaactcataaggatttactttaagaaaaagtcacagaataaactaagtgaaattatatacgccactacaacttttgaatgacaacttttttatcatttaaaattttgtttttcttataactcctgcattgttgtcttcatatttataggaatcgcaagatagttatgggtctgtcggttgcttgcagaaccaagggagtatcgctttccgttgtacgggtggaggagatgaagaatcagaactctcattgcctgatgattgatgttctagatcttctatagggagggggacggtttttttcaatagcacaggttttctttttttcgacggaaccatgggttttggtgctgatctcttatgtatgctacttgtcgttctatgtaaggagtgtttagttttcttcttcttctttgagctttctgttgttgaagttttagactcttttgtagttgccgtatgaggtgcttttcccttggctttgcgatggagttcaggggaagattcatcagaggattcaatttcagaagaacgcttgctttgcctaggtgaatggtgttcatcagagatgtgaggactctcttcaccacttttgaatttgtttgttacatagttgacgcctttttctaattgcgttcttatgaagttttttggttcgtggtcatgatgtggggagagttgcgggctcccttttctagacgcagattttgtaggttgtgattcagaggcatcttttggggcaatttcttttgttttttttgtggatatccaattaatgagacacggattgaaaatactcaagagcactagaagtgccaatgagcttaaacaaagaggaattcctacagagggaataaacatgcatagcatagctccaacaagaactacgacgacgagaacgcatataatgattaggtaagcaatgttgcaaatgtctcgaatcgatttggaaggagccgcttgtttgatcggttgaggtttatggaaatacgaagtcactgagttgcgcaggctaggaataagatgggacatagcaaagttagattaaagctctctgaaaagaacagcttatgtattcaaggtctgtttgtaaatatacagacttttttatacgcattaaatctaccttaatgcgtataaaaatagtgattctcaagagaacaagggttcaacttggctttctattttagcttgggaaaagcaactttgagaacatcatcatagtgtgaaacaaaatgtattttcaaccctgttttcagatatgcaggaagctcttcatagtctctacggttgtcttcagggaaaatcaagatgttcaatcgtgatcttcgagctgcaatcagtttctctcgaatgcctcctacacctaaaacacgacctgtaagagtaatttctccagtcattcccaaattattcactaccggagtttccaacagcaacgaaaggagagaggtcaccatagtaattcctgcagaaggaccgtctttaggggtggctccctcaggaatgtggatatgtacttgagactttggaaagaacgtatagcctggggcataccgatggagagcactgtgaaggtaggtccaagcaatctgagaagactccttcattacttccccagcctgacctgtaaggtgcatgtctgttttgagtgaggacacctgtacactttctatatataacgttgctccacctaaagaggtccaggcaagtcctgtggccactcctacaggagtggattcatagaagcgatcgctagaaaatatcggtttccctaagtaggtctgcagatttttcgaagagattttaaaagtaatcttcttagatttgggtttttcttgattttgaacaatctttaaagcaactttcctcaatacttttttgatattcccattaagagtacgtaccccagcttctcgtgcatagttattgatcatgtactttaaagcttcaggttggaaattcacttcgcttgctgttaaaccgatttctttgcgagctttgggaactagatactttttagcaatttgaagtttctcttctaaaatgtagccagaaagtcggagaatctccatgcgatctaaaagaggatccggaatggtatctagaacattggcagttaaaatgaatagtacattggatagatcaacacgtacgtctaaataatgatcaagaaaatctttgttttgctcaggatctaaaacctctaataaggcagaggcaggatctccatgataactcgcaccaattttatctacctcatcaatcataatcacaggattcatagcttggctttgcttgagcgcctggaccatttttcctggcattgccccaatataggtgcggcgatgccccttgatctcggcctcatcacgcatgcctcctactgagaaacggaagaactttctatgcaggactttagcaatgctgcgccctatgcttgttttcccaactcctggagggcctacaagacagatgatacttccttttaatcctttggaaagcttacctacactgattaactcgagaatgcgttgtttaatctcatcaaggccatagtgatccttgttcaggacgatttctgctttctttaagtcatggtattctttactttgtatgccccaaggaatgattgtcagccaatccaggtaattgcggcatacggtatattccgccgaagaagtttctaaagtctgaagtttttcaatttcatcttgaatcacttccatagcataatcaggaacatggcgttttcttagcctttccgaaaacttctctatatcaatagcgcggtcttctttctctaaccccagttcttttttaatcgtttttaactgctcttttaagaagaattccttttggctttttgtaatcgtagcttcaattttttgattaatgctgctctggaggcggcttaagtctaattccttttttagtaagatcagtgccttatcaatgcgatcatgcatgttggtggtctctaagacctcttggagctcttcccgagttgctgttgttaaagcaacagagaaatccgcaagcttgcctggttcagtaaaatccgaatgaccaagaaaaatttgtagttcttctttaaagagaggatttagttttaaaaggtctttgatgacagagacaatactaatagagtacgcttttagctcttctgtaagctctttattgtccgcatgataggaaactcgagctttaagatatttgtctttaatgggttctataatccgaatacgctcttcaatgcttaaaagaacttgagcactgccaccctcgattggcatgatacggaggattcttgcggcaactccagttttatgcagctggttgaagctcacttttaaaatatcggcgttctcttttttggttaagacaagaccaatatatttttgagacgacttcgctaaaacctttaatacttcataataaggacctgactcaataagaatgggagccgccattccggggaaaaaaggtcgtttatttaatggcaggataaataactcagaaggcagcaaacgctccgtagactgatcttcggattcctcttcagattcatctaaaagcttttcaacatcttctggatttggatctaagatgggggagtcgctattggttgtagagtccacaattgtccttatgctcggctatatttgtctgtcgctccagtaaatacggctctttttctctagggtaaaaagagggagcgattttaaaagattgcatatttcgctatactacaaaatagatgcaattagcgcatatatacaacttctaaaaaatatctagaagggattaaagattaggaaagactcgtgtttaaggcaaatcgtctttttttattttttcaaaaaaaatagtttgtatctactgtttaaaattgctcagagataagggattaagaaaaactccattgtttttgagttttttacttttatagggggtagattttccaagggaaaaacgtcagtagtccaaatccagcctttttgtccttcgtttgcattgaaggtaaatgcagggatcggaagacaaaagaacacgcttgcattgtttttaatttaacagccatttcctcttgttgttctttatgataattaagagcccgttcctcgcctgaaatatttggaacagataccaaggaatgaaaatagaagttagggagaagggaattataagagaagccaatatcttgctttggtgaaggagcttgaccaagatctgtgattttagtgaaagaaaacccttcttgtataagctcgttataggtttttccagaacgcactaaaatgtgtagcgcatgaattttctttaatgttgtaggagatggtaaaggaagactgaggttttcttggtcaggtgtaagtgtttttttcaaatcctccttcttaacatctaggattagaccacgatacttgaagaataagataatgcgtaaaacgatcttaataaagagagctagaatcagaggaagaattaaaatataggagagaatttttattattttttcagatttcgagattgggagggcatgatcaacagatagaaaggtagctccagaaactcctgtgatgataacagaagtgtctcctcccaaatgtaaatagtgttcaacgatattggaacatttttcaataatgccagagctttttcctaggtaaggaagaaaagataaggactgatccgagaagactataggatgaaaaaactgaagaaacatacgttagaatttttattttttttatattataacgtactagccttcaaaaagtaactattctttatggcttagtcttgtttctctcagaatttagataaacataaaatttgatcttcagttccataacagaacgactccaagtaatctcttgtaattgtgcggccatagttggggggattcttggatcttcaatctcaaatgaattcagatattgaaaacgggacgtcccatagagaatatcggattgggtagcttctcgtttgcctagttgttggcgtaagcttattaaactactcttaatagaagtagttctcaatttgatttgaaattttttcaagagttcctgaccccctttcctaagcaaggaagaatcgagtagcattgggcgtaaaagtatataggagtaacaaaatcgcaacccatcgttcatccttatatttagagcggcgaagaatctaatgtatctgaataaattaaaacaataaatgttttcatttctttcatttttatttgattaaaaggggtttgttggtatagtttatttttttatatcaaaaatcgacgcatgtacttctataagtatgttatcatagatacttctggatactatccattcttagcttgtgtggataatcaacaagtgctggagcattggtctttgccagtcggtccagatcttggaattgttttagagtttctttttaaaagtaaaaatctctcttttcagggagttgctgtggctctaggtccaggaaacttttctgcaacacggatagggatttctttcgctcaaggattggcaatggcaaagaatgtgcctttgctaggatatagctctttggaaggatacttattatctaaagatgaaaaaaaagctttaatgcttcctttggggaaacgtggaggcgtcctgactttaagctctgagattcctgaagagggcttgaatgaaaaaaggagaggggtggggccgggagctttgctctcttatgaagaggcctctgattactgcgttgctcatggatattatcatgtgatttctcctaatccgcagctctttgcgagcagtttttctgataagatcaccgtagaagaagttgctccttcggtagaacagatccgcaggcacgtgatttctcaattcatgtttgtagaatatgacaagcagctctctcctgattaccgtagctattcatgtattttttgatttgtattttctaaatattttttacattgttgcttccgaatcgattcaactatcccttgaagcctaatagaagtagtggtacaatcgaggctcttctaaaagacatagtaagaagattattattgtgtttatagaaggccagagatttgttatttattgcgtaataataaggtaatgcatgcccagtgttaaagttcgagttggagagcctgtagatcgtgctctgcgcatcttaaaaaagaaaatagataaagaagggattttaaaagctgctaaatcccatcgcttttatgacaagccttctgtcaagaaacgagctaaatctaaggctgcggctaagtatcgtagtcgttaattggcaatgtcgtattcgttggtagtgtttcaggtatggattattattcaattttaggcatttctaaaactgcttccgcagaagaaattaaaaaagcctatcgcaaattagctgttaaatatcatccggataaaaatcctggggatgctgcagcggaaaaacgcttcaaagaagtttccgaagcttatgaagttctcagtgatcctcagaagcgcgactcttacgatcgtttcggtaaggacggtccttttgctggagccggtggctttggtggcgctggaggcatggggaacatggaagatgccttgcgcactttcatgggagcctttggcggagagttcggaggtggaagcttctttgatggtctttttggtgggcttggtgaagcttttggaatgcgctcagatcctgcaggcgctcgtcaaggagccagtaagaaagttcatattaatttgacttttgaagaagcagctcatggtgttgagaaggaacttgtagtttctggatataaatcttgtgaaacctgttctggtcaaggagctgtaaaccctcaagggattaaatcctgcgaacgttgcaaaggttcgggacaagtggtacagagtcgtggatttttctccatggcctctacatgtccagaatgcggtggcgaaggccgtattatcacagacccttgttcttcatgtcgcggccaaggaagagttaaagataaacgtagtgtccatgtgcatatccccgcaggtgtggattctggaatgcgcttgaagatggaaggctatggagatgcaggccaaaatggagctccctccggagatctctatgtctttattgatgtagagtctcatcccgtatttgagcgtcgtggagatgacttgatcctagagcttcccattggttttgtagatgctgctctcggtatgaagaaagaaattcctacgttattgaagacagaaggatcgtgtcgtcttacggttcctgaaggaattcaaagtggaaccattttaaaagtaagaaatcagggctttcctaatgttcatgggaaaggtcgtggagatcttttagttcgcatttctgtagaaactcctcaaaatttatcagaagagcaaaaagaacttttacgtacttttgcttctacagaaaaagcagagaactttcctaagaagcgtagctttttagataaaatcaaaggttttttttctgacttcacagtataagaaggagaaaagaccgactttagctgagagagatccatgggagtagtacaaaatcaagttatttcttctataagagatgttttaaagctagtctgggaattgcggttcgcagagcataagatgcttctcctctctaggcagagcggctcgggcggcacatttcagttgtcttgtgcaggtcatgagcttgccggcgttcttgctggtaaaagtctcattcctggtaaagactggtccttcccttattatagagatcaagggttccctataggcttgggttgtgatctctctgagatctttgcttcgtttctagctcgtacaactccaaatcattcctctgcgaggatgatgccttatcactattctcataaaaaattgcgtatttgctgtcagtccagtgttgtaggaacacagtttttacaagccgcaggtcgtgcttgggctgtcaagcactcgtcagctgatgaagttgtctatgtttctggaggcgatggagctacatctcagggtgaattccatgaaatgttgaactttgtagcactacaccaactgcctttaatcactgtaatccaaaataatcattgggcaatttctgttccttttgaagaccaatgtggagccgaccttgccagcttgggtcgttgccatcaaggattagctgtctatgaggtagatggaggcaactatacttctcttacagaaactttttctcatgccgtagatcaagcgcgtcaacattcggtgcctgcattgattttaatcgatgtggttcgcttgagctctcatagcaattccgataatcaggaaaaataccgctccgctttagacctgaaactatccatggataaggatcccttaatccttctagagaaagaggctatcaatgtttttggtctgtctccctttgaaatcgaggagatcaaggctgaagctcaagaagaagttcgaaaatcttgtgagattgctgaagctcttccttttccctctaagggatctacaagccatgaagtcttctctccttataccgagactctcattgattatgagaattctgaaagcgctcagaatttgcgtaactctgaacctaaagtgatgcgtgatgctatctccgaagcccttgtagaagagatgactcgagattctggagtcattgtctttggtgaggatgtcgctggagataaaggaggagtcttcggtgtcaccaggaatttgacagaaaaattcggaccacaacggtgtttcaattctcccttagctgaagcaaccattataggaaccgccataggcatggccttagacgggattcataagcctgtcgttgagattcagttcgcagattatatttggccggggatcaatcagctattttctgaggcctctagcatctactatcgttcagctggcgaatgggaagttcctctggtaatacgagccccttcaggaggctatatccagggaggaccgtaccattcgcaaagtatagaagggttcctagcacactgtcctggaattaaagttgcctatccttctaatgctgctgatgctaaagctttgctaaaggcagcgattcgagacccgaatccagtagtgtttttggagcataaggccctctatcaaaggcgtatttttagtgcctgcccagttttttctcatgactatgttctgcctttcggcaaggccgctattgttcatcccgggaaagatctcacgatagtttcttggggaatgcctctggtattgagtttagaggttgctcaggaattagcctctcgggggatttccatagaagttatagatttgcgtactatggtgccttgtgacttcgctacggttctaaaatccttagagaaaaccggaaggttgttggtgattcacgaggcttcagagttttgtggctttggcagtgagcttgtcgctactatgtcggaacaaggatacgcttatttagatgctcctatccgtcgtcttggtgggcttcatgctcccgttccctactctaaggttcttgaaaacgaagtgcttcctcataaggagtctattttacaagccgcgaaaagtctcgcagaattctaggcgattctccagcttctttctaggccgggattttaattcaaaaagagagcccgacacgctgtttgtagaggtacttgggagatgctatttactgaaacattagagagtgcgtactcttctttggatgctaataaaatgcgcacggattctaaaagagcaagatggcaacaactctcccatgtagtaaattcctcttgatctgcgctgaggttatttaatccaaaaacttctaactgtacactttcaagattgtgctcaatacagatatcaaagcattgcaaataagccagtactaaattagtaaatgcctctttcatactaaaatctttcaatgtaattgcgcggcgcattttttccttaatgagagtttctaatgtagggggattgataacaatcagatgagaggtgtacagttgcgcgccctcttctacatcccaagggccagaaacgcatgaacctataggcaagtgtttttctggagtgggaatgttgtttttgatcttttcccagcagctcctttgtaaacatgttgtaacagcaaacgctcttcctaatgttgtggagaaatccatgctagaatgtgaagagataacaacagcccctgattttttatttagaattttatcatgagaaaaatgtcctttaaagcagtgaaaacggaatccagatttttctttagatctcaggagaatacttgctagcttgttggaatacttacgatcttcgggtctggtttctggatctagagagaatagctgcttgagtaacgaaaaacaagccttaggatcatacgtagagggataatgtatatcaggattgcaggtcagttttgttctatcgactttaggtagagttggaggtaagggtattcctggagctggcgcgggtatttctggagttagtgtgggtgctcttagagttggtgagggtggaggagtggggagtggctcaggaatcttaggtttttctaggtagtgtataaaatacaacaacgtaaaagcaataaagactgcggtaagtatgaatagaggcatggtgatctctagggaacaccctaggcaaatggcaaaaactccccctaggcaagataggaatgctaaaatggcaaaagcaattgcgttgactattgaagatggagtttctttcttgcgttgaggtttaaaaggtgcctgcgtggggattgtagggatatggtcaggagaagaatctggatccggaacaggcggtgtcttctgggatacaatagaggagtcgggtaaagatggagtcgatatttccgccataagaattcccctacaagttgttggcaataaaaaatttacttaattttaatataaaaacaaatcagaaaaacaaagattattttgatttgtcattagaatattgttgttttatagggtttcgatgaagcgataagaagtcgcagaaattgatgcatagggggagacgtttgtgcgtaaaattccaatgaagaataaaataagagaagctaaggtaagcatccaaggagggacaggagcaaaggaaagagtctttaggatattggggttgtgtagccaaggatgtgagaggaatccctggataagcgcttcggtgataggggagcaacatggcaagatgattgttgcaatgaggaaaacaatgatggggagaatggtaaaaggaacaatgagattatagaggagaccctcaaggggtaagctcccaaagtactgcatgattggcagaacaataaagagttgtgccgatagtgaaattgccaaagtcatggcaagatagcggataggatacaaccaaaatggagagagaaactgagtccaaggggtgtagagaaaggaaaagatcttcgggaaaaagagtagaatccccaacgtcgctaagaagcttaaaacaaaggtaggagagaagggcgaaaaaaagatagaacataaaataaagcctgcgcctagacgatttagccccgaacaggacccagaaaaacaccatgaaaaacaaagtagggttacggagatccaagagcgccataccgagagagacatagggaaaatacaggctagagaagtcagaacaatgaagcttaagatttttttgatttttaaaggaagaagagcacagagcatccagagagtagtagcacacagagagaaatgccagcccgagatagcaaagagatgagataaccctttttgtctgaagaggtctctgagattttgaggaaggggagttcctagcagaagactcgaagcaaaggggcctacctcagaagagggaaacctatggttcaggaaatggcagctagattctcggcatttctctttcatgatatagaacctagacctaggaatttctttgtagcaagcattagacttaaaaacaatttgagatgtatgatgtagtgtcccttcgagctcgtaaacctttttaagctctaaacgggattctgatagaatttgacacgagaggtggtgggctcttttcccacagggcgtctgaatacaaagagcttctccgtagtaggttccttgcccccctgcgtggtgaatcacaaaagtccctgatatagggccgtcatggaggaatggcgcaggagttaacatcaaagaaatgatccaagcacttgctaaagggagccattgtttagggttgcgaggaaggaacattcctaagaaaataagaatcagagcactacattctgggtggccacgggatgtgatgccagcaagccaatagagcccacataagaaaataggatgtctttgttggaagcactcacaagaggcgcgtaatcgaatgagccaagagcttatgggatagcgaaagaaaaaagatgaaaaaacctgacaacgattccacatttgatgttcgctctttctttcccttcgatgtgttatgtatagagcagttgcgcaaggaaatgtcttgggaagtggtttcagcgaagatcccgcgtcttcctcgagggtggtacgagctcatgggactatcaaaagaagatcgtatagatttttgcttagacttctggtgttccgtactagggattgagcataaagaatctccaagtatttgtcgttttttttctttactagagaccattgaagtttacatctatcgcttggaaaaagaaccttatcaactaaagatgttttatgtattccgtgatggtcgttgtgggtttcaaggagagcctcctcttctagattttttagggcatcataggctgcctcctttaggggaccgccattacgagaaatttttctctattcataatggattcgggaaatgggaggatgaggggattttccccatgaggtctttagcaaaggtacaacaaaaattacgtcagcagctcgttgtaatgaataagatgcaggcggaagataattgttattctttaggtatctttcctttttatggctatgaagagccttttgcttatcagagtttcttttttgatcctgaaatacgcagagaccttccttctccgaatgtgttgttaaatgaagagagcttggagcatcgaagcttagaaactattgagttgttgcatctgtctaagagctattatccttctttcctctcgtggttggagaactatctacatagtgaggaggtgtataatgaatgagcctactcgcacttatctagaaagtgagaaagatacacaagatcagatcgaagagctccaggcaacttgtatagttaagaatgcagcaggaatccatgtgcgtcctgcaggtgttattgttcgactctttgatggagagccttgtgatgtgcatttcacctacgcaggtaaaacgataaatgcaaagagtatcatgagtattcttatgttgggagctccacaaggaggagagattcttgtgactattagaagcaaagaagctcatcgtatcttacaaaagatacaagatgcgtttagttccggttttggagaactataaatggatacacagtcctctacaggtaacgaagaatggcgtattgcaggaacctctatagtttctgggatggccttaggtaaagtattttttttgggaacatcccccttgcatgttcgtgagctgactctacctcaagaagaagtcgaacatgaaatacatcgttattataaagctttgaatcgctcgaagtctgatatcgtagctttagaacaggaagttacgggacagcaaggccttcaagaggtttcctctatcctacaagcacacttggagattatgaaagaccctctccttacggaggaggtggtcaatactatccgtaaggatcgtaaaaatgcagaatatgtcttttcttcagtcatgggtaaaatagaagagtcgttaacagcagtccgcgggatgccttctgttgtagatcgtgttcaagatatccatgatatctccaatagagttatcggccatctgtgttgccaacataagagttctttaggagaatctgatcagaatttgatcatattctctgaggaattgaccccctcagaagtcgccagtgctaactctgcctatatccgagggtttgtctcattagtgggagcagccacatcacatacagctatcgtctcgcgagcaaagagcattccctatcttgctaatatctccgaggagctttggaacatcgcaaagcgatataatggcaagttagtcttaatcgacggttatcgtggagagctaatctttaatcctaaaccagcgactctacaaagctgctataaaaaagagctttccgtggttgcccatacctctcagagattagtaagaaagtccctacacccgattgtttcttcgcatgcaggcagtgataaggacgtagaagatctattagagaacttccctcaaacctccataggcctctttcgttctgagtttttagctgtaattttaggacgcctacctacactaagagagcaagtagatctttacgagaagctcgcacgttttcctggagattcgccctcagtactgcgcctctttgattttggtgaagacaaaccttgtcctggaataaaaaataagaaagaacgttctatacgatggttgctagactatagtgtgattcttgaggatcagctccaagcaattgctaaagcctctttgcaaggctccataaaggttctcattccaggagtgtctgacgtttctgagattatagaagtcaaaaagaaatgggagaccatccggacgaggttccctaaaggccataaggtttcttgggggactatgatagaatttccttctgcagtttggatgattgaagagatccttcctgaatgtgattttctctctatagggacgaatgaccttgtccaatatactttgggaatttccagggaatccgctcttcctaaacatctaaatgtaactttgcccccagcagtgatccgcatgattcaccatgtacttcaagctgcgaagcaaaatcaggttcctgttagcatttgtggagaggccgcagggcagctcagtctgactcctttatttataggcctaggagttcaagagctctcagtagctatgcctgtaatcaatagacttcgcaatcatatcgccctgctagagttgaactcctgccttgaaattacagaagcccttttacaagctaaaacatgctctgaagttgaagaacttttaaatagaaacaacaaaatcacatcataaaaattccattatactttttttatataaagatcttttatgatgtataaagtttgtaaaaactgtgttttctagtcgtgccaatgtgcaataggaaaaaataccaactccacggcggatctctagttctagaaaggcattgtggaacgcataagagacatttcttgatccatctgctcttttgcaagtttgaatgcagcacggaacaagtcttcaatgacttctggatcttcagggtctaagcacgtaggttgtacttttactgaaattaagtcacactttccgttgatgacaacagagacaagaccgttgccagcttgcccttcgtaacgcttttctaatagtgaggcctccatttctaggaattgctgttccataattttagcttctttttttttcttagcgtatccgctgcccatgcttatctatccttaggtgaaatattgatctttcctctcatgaaattttctaagaggttcttgcttattgtcttaaaattcctgaaaattctacaacagcaaactgtaataatgtgtctacagctgcagattttattgaagctgagcttttaacttctacagatataattttaccttccgcagcaggttgattttttttctctaaaaaactctgttctttgtaggtgggctgaggttgaggagctgatacttgctgcgtcaaggtgggctccttaatattgcgaagcccttcaaactgccgactcttaatagaagagatcaactctgataaaacaggcctttgataaatgcgaatgatatgaatgatgacggtttctaaaaatgtctgttcgaagatggtattttgtaggtgcttagcagattctccaaggaaatctatgatttctagaagctgctccgtcttatactgagagctgaacttgcttgttgtagaattcgtaagaagaagattacgataaaataatgtaaggtcatggagaaatgtgacaggtgctaccccagaatttaagaagtccgttacgatccctaaggctgtcgcatagtccctttgaagaatcgcattgtctaaagtccggagagaatcttgggaagcaaagcctaaagcttgggcaaccgtgtcgggagagagagatttaggaaataaagatattacgtagtcataaagagattctgcatcacgcaagcttccttgtgctgcacgggcgatcggcgccaatgcttcttgcgacgcctcaatatggtcatcttgagccataagcgatagcttctccaggatcgttttttcaggaatcctttgaagatgcattttttgacaacgacttaaaatagttccgggaattttatggatttctgtagttgcaaagaaaaattttacatgttgtggaggctcttctaaagtcttcaataaagcattgaaggcttccttagtgagcatatgaacttcatctatgatataaattttaaactttgcttttacaggagtgaataatacagtttcattaatttgacggatatcttcgataccacggtgggaggctccgtcaatttctaaaacgtctaaagaggatcctgaagcaatctctttacaagaaaaacactggttgcagggctcgccatcctcgctaagatgcacgcagttcagagcttttgctaaaatgcgagctagtgtggttttccctgtaccacgaattccagaaaatagataggcgtgggcggctcggttgaagaccaaggcattttttaatacagcgacaacagagctctgacctagaatttctcgaaagatttgtggacggtactttctagaggatgcttggtagggttgtagagtcattgtataaccaagagaatgtgtatagaaagctcattttctcatttaagagattttttcttgaagaccttttctgattttcataagaaaattcttttcgcagagatggaatgattttccttctaaaatagaatttgtgaattcttctttagaaggaaaatgaatctctttgaataaaatactatatattagtagcttagtgggtttaacttatgtgtttgatcgcgatggcaccacagattcataatgcaagtacctctatcaccacagctacccccctccccaacactctgtagggtcgatttcttctcgatataaacttcgcgttttagcgattacttttttagttcttggtgtgcttttactgatttcaggagctctctttttgacgttggggataccaggactcactgcaggggtctcttttggattaggtataggtctctctgcgttaggaggagtgcttgttgtctcaggactactatgccttctagtaaaacgagaggtttcgaaagtatgtcccgaggagattccggcagtacaaccagaagagactcctgaaggggttcctgtgactccatttgagaagccagctctagatgaagcccagaaggagcagaagactcagaaaattttagatcagctgcctcaagaattggatcagttagataggtatattcaggaagcgttcgcatgtttaggaccgctgaaagatcttaagtacgaagatcaaggttttttacaagacgtcaaggaggagtttcaagtttttgactttgttcaaaaagatatgattgcggagtttgtagagctacagcagattctatgtcaagaagggaggttgctagagttcgtaatcaatcagacacgatatataggaagagatctttttaaaagagaggatagtttatataaattatgggaatggcttgggtatttaccttctggggatgttcgaggggagcggttaaagaaatctgctcgtgaggttgtggatcgctttatgagaacgacttgtaacatacggaagatagccatgacttttgataggcatgtttatagtgtggcgaagacggcctttgaaaaggcatttggagccttggagacgtgtgtgtatgagagtatgagagagagttatagagaggcattttgtgagtatgagaaggcgaagctgcttggggatgaggagaagagtgcacatgccgagcaaaggtttcaggatataaagaaccgttgggaggatgtaaaggatgcattcttttgggtaaaagaagatgggaagattgaaattgatgatgcaattggaaacagttgtaaatggagtgagcgttatgaagagcacaggattactcgagcaagatggtataaggtcgcggagcatcagttgtttaatgcgactatgagagtgaaagattcgttacgagagcataatgaagcaagagtcgcttttgagaaggagagatctaaggagaatcagaggcaagtccaaaaaaagaaagaaaagaggttgcgagatttaaaggaattgcatgatcaggagcttccgagagcacaggagaggttgagagagctgcaagctttgtatcctgaaattgcagtctctgttgtagaggccaggagagaggtagcctctgatttagagaaagctcatgagagtattgacaagcactatcaaagctgtgttcgagagcaagagctctactgagaagaagaagagaaacaggaagcggagtttagggagaacggcacaaagattcgctctatggaggaggtgtctgagtatcttcagcaagtagaaaatcagttggaatcctgttccaagcgattaaccaagatggaaacttttgccttaggtgtgaggttggaagctaaagaagagatagagtctatcatactttctgatgtagtgaaccgttttgaggttttatgtagagatattgaagatatgctatctcgagtcgaggagatagagcggatgttacgtatggcggagcttcctctacttcctataaaagaagcgcttaccaaggcttttgtacaacataacagctgtaaagagaagttaaccaaggtagagccttactttaaagagagccctgcatatctaactagtgaagagcgattgcagagtttgaatcagactttacaacgtgcgtacaaagagtcccaaaaggtttcaggtttagaatcggaagtgagagcctgtcgagagcagcttaaagatcaagtaagacagtttgaaactcaaggagtgagcttgataaaagaagagattctctttgtgactagtacctttagaactaaatttagctatcattcatttcgattacatgttccttgcatgaggttgtatgaggagtattatgatgacattgatctagagagaactcgagctcgatggatggcgatgtctgagaggtatagagatgcttttcaggcattccaggagatgttgaaggaaggcctagttgaagaagctcaggctcttagagaaaccgagtactggttatatcgagaggagagaaagagtaaaaagaaacattgatttgcgctaagctaacagcagcgcagcagcgagttgcagcatttgaatccatagaagttcctgagattcctgaggccccagaagagaaaccgagtttgctggataaagcgcgttctttatttacccgagaagatcgttcttagaaccactctaggagtctctaggccctgtttttttaaattctttgaataaaatactatatattagtggctgagttagtttaacttatgtgtttgattccgatagcaccacagattcataatgcaagtacctctatcaccacagctaccccccccccccccagaccactctgtaggggcttctttttgtctgtctaaatttcgtgttttagcaatcacttttttagttcttggtgtgctcttactgatttcaggagctctctttctaacgttagggatttcaggagtctctcttggagttggtttggggctctctgcattaggaagtgtactcgttatttcgggatttctattgcttttagaaagacgagaggtttcgggagtgggtttagaggggattccgacaggtattcctgtgggtccttctgcagaaccttcttcagaggaaatacagaagaagcaaaaagcaaagcaaattttagatcaactgcctcaggaactagatcagttagatacggatattcagcacgtgctctcatgtttagggaaactgaaagatcttaagtgcaaagatcgaggtcttttaaaagatgccaaggagaaactgcaagtttttgactttgtttggaaagacatgatgatggagtttgtagagctacagcaggtcatggatcaagagagccggtatctagagggcctgatccatgaggtacaaagtatagcacacaaactttttgtagatgatgtaaatattagatcccatttaggggagtcgtgcgggtatttaccttccgaggatgttcgaggggaactgttaaagagattcgctaaagaggtcgtagctcgctttatgaaagtgactcgcgacatacggaagatagcaatggcttttaacaaaaatgcctatggggcagcaaaaaatgcctttgataaggcttttggaagcttggaaacgtgtctgtataagagtctgactaagagttatagagataccttttgtgactataagagagcaaagatccttccggatgagaataatagcgctcgtgccgagcaaaggtttagggaagtcaaggatcattgggaggacttaaaggaaacggtcttttgggtaaaagaagacggtcgtattgacatagaagtgctcactgcagtcggtgggtggccagatcgttatccagagcatcttattcttgaaaaaagaaaggataaggtaatgagccatcagttgtgggaggcgactatgcgtgtgaaagaagctgaagtaacgtatagtgtagcaagagtcgcctttgaaaaggatggatctcagcagaatcagaagaaattccaagaaaagacaaaagagaggctgcgatgtttaaaggatttgcgtgatcaggagtgtcatcgtgcacaagagagattagaaaaactgacggctttgtatcctgaggtttcagtctctgtagtagagacggagagagagaggaaatttaatttagagaaagcctatgggaatctcgaagagcgctatcagagcgttgtgcaagatcaagaggactactggacagaacaaaagaacagggaagcagaatttagggcgaaaggaactaaggttcgctctatggaggaggtggcagagcatcttcagatcttagaaaatctattggaagactgttataagagattatcaaaagcagaaacttttgccttaggggtggagagggaagctacagaagagatagagtataccatactctctgatgcagcgaaccgtcttaaggttttatgtgaagatattgaggacaccctgcctcgagtcgaagaaatagagatgatgctgcgtatggcagagcgtccactccatcctataaagcaagcatttaccaaggcttttgtacaatataacaggtgcaaagagaggttagcaaaggtagagccctattataaagagagccctgcatatgtaaatagcgaagagcgattgcagagtttggatcaggcttcacagtgcatacaaagagtcccaaaaggtttcaagtttagaaacggaagcatgtacatatagagagtatcttagagaacaagtacaacagtttgaaactcaaggagtgagcttgataaaagaagagcttctctttttaagcagtactctcaaaagtaaattgagctatgatccattaatagcaaacattccctgtatgaagttttattaccagtattatgatgacattgataaagcgagagctcaatcccgatggctggagaagtctgagaggtatagaaatgctaagaggagattccaagagatcgtgaagaaaggcctattcaaagaagctaagcccttgaaaaaagaggagtataggttacttcaagaggagagaagcaataaggagaagcgtttgatttacaataagatggcagtagctcggcaacgagttcaagaatttgaatcgatggagattccagaatagaaagtaagtcttatggataaagcgcgttctttatttactcgagaagatcgttcctagcacaactctagaaacctatgagttgtgttgctttaaaaatttttttgaataaaatgctatgtattagtagcttagttggttaaacttatgtatttggtcacgatggcatcacagattcataatgcaagtacacgtatcacccaccacagctaccccccgatcactcggtaggggctacttcttggcaacctaagcttcgtattttaaccattacttttttagttcttggtgtgcttttactgatttcaggagctctctttctaacgttgggagttccaggacttgctgcagggctctcttttggattaggcatcggtctctccgcattaggaggcgtactggttgtttcaggacttctattctttctcataagacgaggggtttcgaaagttcgtccagaagagattcctgtgactccttcccatgaagcccagaagattttatgtcagctacctcaggaactggatcagttagatacgtctattcaggaagtagtctcatgtttagggaaactgaaagatcttaagtacgaagatcaagggcttttaacagaggtacaggagaaacttcgagtttttgactttgtcaggaaagacatggtgacagagtttttagagctacagcaggttgtggctcaagaaggacaatttctagattacctaatcaatcaggtgcaaagcatatcacacaaactttttgtacctgatgtaaatattggagctcatttagcggagttgtgtgggtatttaccttctggtgatgttcgagtggagcgtttaaagagatctgctcgtcaggttgtagatcgctttatgagggtgacttgtgacacgcggaaggtggcaatggcttttgacgagaatgcctgtggagtggcaaaaaatgcctttgataaggcttttggggcattagaagagtgtgtgtataagagtctgacagagagttatagagaggcattttatgaatatgagaaggcgaagatccttaggaatgaagatgtagaatggctgcaggataagaataagagcgcacgtgctgagcagagatttagggaagtcaaggatcgttgggaggacttaaaggaaacggtcttttgggtaaaagaaaacggttgtattgacctagaagtgctcactgcagtgggtgggtggccagatcgtggtccagagcatcttattcctgaaaaaagaaggaataaggtaatgagccataaattatgggaggcgactatgcgaatgaagggagcagaaggaacgtatagtgtagcaagagtcgcctttgaaaaggatggatctagaaagaatcagaagaaattccaagaaaagacaaaagagtggttgcgatgtttaaaggatttgcatgatcaggagtgtcatcgtgcacgggagagattggcagaacttgaagctttgtatcctgaggtttcagtctctgtagtagagacggagagagagacaaaatttaaattagagactgcttatgggaatctcgaagagcgctatcagagcgttgtgcgagatcaggaggactactggaaagaagaagaaaacaaggaagcagagtttagggaaaaaggaacaaaggttcgctctccagaggaggtggtagagtatcttcagatcttagaaaatctgtcggaagactgttctaagcaattaactatagcggaagtggttgtcttaggtgtagagctggaagctacagcagagttcgagtataccatactctctgatgcagcgaatcgtcttaaggttttatgtgaagatattgaggacatcctgcctcgagtcgaagaaatagaaatcatgctacgtatagcagagcttccattccttcctataaagcaagcatttactaaggcctttttacaatataacagctgtaaagataagttagcaaaggtggagccctactgtcaggagagcgtggactataagagcggtttcagagtttgaatcaggatttacaaaatgtataccaagagtgccagaaggctacaggtttagaatcggaagtgagtgcatatagagatcatcttagagagcagatcacagagtttgaaactcaagggctggacgtgataaaagaagaacttctttttgtgagtagtactctcaaaagtaaattgagctatgatccattaatagcagacattccctgtatgaagttttatgaggagtattatgatggcattgataaagcgagagttcaatcccgatggctggagaagtctgagaggtatagaaaggcgaagaagggattccaagagatgctgaaggaaggcctattcaaagaagatcaggctttgaaaaaagcagagtatagattacttcgagagaagagaatgaataaggagaagcttttgatttgcaataagatagaagcagctcagcagcgagtccaagaatttggaccctcggattcataatgaaaaatgacatatcggctcttctccttctgatatttcaggagtctcaagcaatgtttttcgcctagtgctctattttgtctaaattttagagaggaaggtcgcagctgaaggctttcatttgtagacattttatagaaaaatcagaaaaatacctttagaaaaaataagaacactttcatcttaaagtgactatagtgggattttttagatttgttttagaaggcattttaacgatgtatcattttcaaaagattcgcatgacacttacaactcagggatttgttcttaataaatctttaaggaaggattatgaactgtggtttgtctatggatcatgtccagaatctaaggtaaaactacagacttcctctcataaatggttgtgagacgaagttttctaagtgtgtggttagatagatgaaagaacttagacatgaatcctataaccgtgcattacataagctaagccatcaatgggttcgctactttctctatactttcgtatcgtgttccttcatagtcgccatatttacttttgcatggttaaaggtcctctatgttcccgaatataaggctggtgagatctcacgtatttctctgacagctcctatggatttttctttaagttggagcgctcataaattttataaacgtactgcccacatttcagaagcctttgggaaggtctatcatcttacactctctcccggtagtctcctcagcaaagaggggaacgccgatgaaaacactgactattggtttaaaaaagcagctgattttttgttgtctaccaactttgtcgatagttcaactcaaaaatgtcttaaggacttgtgtatatatcctcctttattggggaaagaaaagaaaaccttagaaatcaatatcaactcgaataaagggaatgttattgctcagtgcttctgccacttaaaaatttttcttatacaagaaaattgtccccagccctgttttgatgcaatcatggatattttgaagatcgccaacttcgaagtggccgtggataaggaaatgtcaggttgtgtgaaaggagagcttctcggaaaacgttgcattgagaaaattaccaagggcacacctatattagaaaagtatcagagaatcgatgatcgggatgctaaaattctaaagcagcttcgagcgcaactcctttcagtgcataccttattttcctgtagatccttatggggggctatttttgtagttttactcatacttctatggggctacggtgctttgaaagccctgtgtcctgagatgttgaaatctccccagcgctttatgctctatattgcgattctaactctttcgttgctgtggtgcagagggacagaaatcttttgcgcctattgggtttcctatctatcttacccaccgattttaccatttacagctgtactcctaggatattttctaggtcttcccatagcaggattttcctgtacgtttcttgcccttctctacaccttgggatccgatctttggaataatagttggtttctatctataaacctactttgttcttggagaatcttagtgagcttacatcgcgtcagtcgcctttcttcggtgttttgggcgtgtatgaaacttggaggcgtagctatgggaagcctgctcatgtttcggatatttacaaatacaatatcaagagaagccctatatgctgatgggatcgaaagcttcgtttatagtctgatcaccgcaatcagcgttgttgctttgatccctgtcttcgaggcttctttcggagcttctacaaacttttcgctcctcacctatttatctcccgaaaacgcattgctgaagcgtcttttcaaagaagctccaggtacctaccagcattccgtattagttggaagcttagcagaagctgcagctcaagctataggtgcagatagcctctattgcttggttgcagctcattaccatgatatcgggaaactgattaatccaggatttttcagtgaaaatcaaaaaatcttacaacaatctggtcattcgctatccccattagagtgcgctaagatgattatgcgccatattcctgaaggggtgaatcttgctaggcaggcagggcttcctgagtcttttatccaggtgatagaagagcatcacggaacctctgtgatccgctcagcatactacagccatatggtagagaacccttctacagggagctttgatgaggaattattccgatattctggaaataaaccctcctctaaagaaactacaatcattatgatcgcggattcttttgaagcagcctcgcgatctctaaaaaatgccagtcttccagatctccaaagactcatcgatcagattatccaagggaagttacaagacggtcagttttcttgttctccaattacgttagatgaactcgctttgattagcaagagcatggtgcaaaccctctacggagctctacattctcggatgaaataccctgaaatatcgtatcaaatttctatggattcctgccccaaaccctctataggaggaacttagttctctagattacgtggcgtttgatttccagcaaatgtgctttgaaatataattttttatgctctcatatgtagaaagagaaaaaagcattagaatgccaagaagcagtagcgacaaaacgaccaaaatgagaatagggactaaaattcccagtcctcctaggatggaaatgcaaattaggccgtatccgtttacgaaggcctcgacacactctttctgttcgcaagaaagcgaaggcgagtacccgatctgaactgtagtccgatctagggatttttttatttgataagcacggaccaaacccgcaattggtactagactcacaaatatcaaaaacacgttcgaaaagcagtctaaactaaagggtttttcatccacccaaatagcacggctttttttctggaatagtttgtttgagtccttgtgagtgtgacctgggatatatatcgtgtttcctgtcaatattttgtcatagtaaggttgatgtagcatagtaagccaaaaaatttcttgatagataactagcaggtaaacgatattccttcttttctctttcagtcaatggtattttttataagtcactaagaataaaaactcataaagatggtctagcttcgctttgcttatttttaacttctacagtgtctaaaggggaagaaatgtagtaaaagactacaaatgagacatgcaattacgccaaggtgttatttagcaacaataaatttgtaacagtatcagaggacactgattgacgcaaagcaaagcaacaaaggcgaaatggcaacatgattaactgaaaaagcacagaaataagtaggatagctaggagcagaagaaatatagggagaaggattccacatccaccaagaattccagcggtctttatagagcttgtcagtctagatgacatcctacatagcgcatttttgcagttagtagaggggagatagcctaagttagccttgacattctcgtcattccagtttgtttgatgctttgcatatctcattgcaagaaatattccgagaatgggaaaccatgagacctatatacatccaggagtgctcccgagtagtcatgctcaggatgttagcagatctacagtttaccccagtcgaagttttatcatgagacgtatgctcatgggctggaatttcaatcgtgttccctcgaagagctccgagcagttaatggatggtcatcgcatacctcttatattttttgggaagcatcatcctactatatctattttaaatgtcaatagattttcttggctctccattttttacaatggagaaagggggttttgagaagaaaaccaaactcaccatacagattaaagtacaacaaaatctaaggaagaccagtttgtattttagcagcatcatagaaatacttgatggtttatgagagctatataggaggaccctctatccacatagtgtctccagattcaggtagtctctcctgcgattctatgaaaagcgaggggagagttatgaggagtggcagtgtataggggtaaataactgtttccatttacctgcgtgatccttggctgtaattgctaaggatccttgtagggcatggtatggaggaggaagttctatactataagcatgatgcaggtgaagtcttaaactcgcagctttcgcaagaacaatagcatcataatgaccacggtggagctgatccagcctctcttcaatagtgcctcgaatatccaagatctgtccttgaggaaacagttgttttagtactgcacttcgacgtagagaagaactccctagccggggactcaagggtaggggctcatgaacatagtggtcagcatacactaacaggtctgcaggatgtagacatcgtgttatggcaactacaggaagagagggagtctcaggaagatccttagcagagtgtatcgccagatcgcagactcctttatggactaaggcatcgacgccatcagtgaaaaaataagagttttctacaagatgtaaggggattttcttctcacgatccccagtagtctctgtagtgcttaactggaaccaaagtttgggataccacgagcgcagcaaagaaatacactcatgtacttgagctttcgctaaatttgaatttctagaagcaatacgaagggggcgcttgccctgacagaaatcacttaaacaggggtcagagtaacagacggatagcatcttttattgttttcactccttgtaaacgaaagttttctcgaatttccttgggaagagatgaaatttgaccctcaggaagaattgcaccttcaaatcccatgagttttccctctttaatgcgtctctctaaatgagccacatgacggatttctcctccaagacctacctctccaattacaatggaattgttaggtaacaggcggttgtatagcgaggaagcaacggcaagtagagcccccaagtccgcagcaggctctataatctttaaaccccccgtaatggataggaagacatccatggtaaatagtttgacttgagcccttttttctaatacagctaaaagtaaagaaaagcgattcggatcgaatcccgcagtcttccttactggattagcaaagggagacgaagagaccaaagcctgcagctcgataagaagagccccagagccttctataataggaatgatcatagaccctgtcgttggccccgtcttttcctgaaggaaaagtcctgaagggttgctaacctctttgagaccatctgcatgcatcgagagaatcaatagttcatttgtagggccaaagcgatttttcacagagcgaatcatacggtaattcgcatgggaattcccctcaaagtaaagtacagtatctacaagatgttccaataccctaggacctgcgatctctccagattttgtcacgtggccgataataaatgtcgtgatctgcgcacttttagcaatctgcattagttcataagtaacttctcggacctgagctaccgatcctggtgcagagtttagcgtggggttaaatataatctgaatggaatcaataattaaaatatcaggttccaaagtcgctatttgctgcttgatattgtccaagtttgtttcaggaaataaataaatcaaaggtgatgagatattgagacgcttcgctctcaaagacgtctgcgttacagattcttcaccacaaacataaagaactttatacttttgcgatgccaatctctccgcagtttgaagaaggagtgtcgactttccaatgccgggatccccaccaagaagagtgaggcttccacgaacaacccctcctccaaggatgcgatcccaccccgcatgatcaataaatatccgagattcattctctaattcgatagagcttaatgcaatcgcactcgtagaagatcgcgacgaagtcccagatcgagcctgggggacatattcttcaaccaaagagttccagttgtggcagcctggacattgccctaaccatttaggagcagtagctccacattgattacacgtccattgtgttttggtttttgttgccatacgtatctagtgcctgttgtgctgcaattttttctgcttcctttttggatgacgcatttccctctccccaaacctcttgattcacaagaacctggatctggtaactgacatttccttgagcatccgtaactgccgtggattgatataccggaagaacgcgaaactgcttttgtgtgaactgctgaagaaggttcttaggattgccagacattaaaggaagaatttcttctctaggaggaaggaggggaaccgtaagtttcctagctggagaaagacccccatccaaatacacagcacctaaaatagattcaaatagattggcataggcagaaagacgtcctcgctcactctggattttttccccttttcctataagaagataatccccaatccctagcatggttgtataacgacagcacgcttttgcattcactaaagaagcccgtgccgtggatagagttccctcatccatcgaaggaaagagaagaaaaagatgctcagtaacaatgagaccaaggacagcatctcctaaaaattctaaacgctcactatcttcaatttgcaccgccgactcgtttttatatgaggggtgagtcagcgctatttctaagagcttaggttgtgtaaatgtaaaatttaacttagcttcaatagccgtgatgtctatagggggatgcatagataggagggcgccgtccttaaacttagagttgggaatttttataggcggaaaaaagcttaaagtctatagtgcttttggatttgttatcttattcggatacgtatgaggtctgctctacacctccaacacttgcgccatttccataaccacggctctattttatttgaaaatcttctgactataaaagattgttttttattagaaacaaaattacaaaattttattgccaaagcatcaaaaactatagacactgtgcggtggagagagaatatatttcgctcaatgccagagatttatacagtcgttcgtaaacggcgtttggatttctttgcagcggaattggtgcaccgccccaagctttccctcgttcgagatctctgggtcttcccaggagaagagatccttgaaggagaagaagattgcatgcttttccttttactttcaggagatcgtgcaggaagcggtatattctttacaggaccctatccttcagatctttatgaattggagaagggaactacggggttgcttttagctttctcttctgtagggattccagtaatttaatctttcttctctcgctctagaaacagaaataagagacagggacttacagttcttattgcctccatgttttgattcagcatctttctgaaggaaaaatcaccatattctttacaaagagcttctcatgttttagttccccgcttgctttcaatacttaattacaaaaaccacaggccgaagtataacggctttgagtgatcaagtgtattctataggatttattttgaagggtggattcttaattaagaaaacctttctcaaacaatggattataccagaccaagcttgaagaatccctggactttatgcaaaaagggtgttaagagttcctgaaactatccttacataggatttctttaatgaaagaagtagaacaacgtatccggtcattatacgatgcagtaacagctgaaaatatttgtagatggttgtccaatgattgtacccaacaagatgcaaagactatcctaggatggttagatacagatcctgcacagcttgaagatctattcggagcgactcttacctttggtaccggaggactccgtagtcttatgggtatcggaacaaataggatcaacctgtttactatacgtcgaacgacgcaagggctggttcaggtgctccgcgctcatcttccccatcccggagatcctatgcgtgtagttgtcggttgtgatacccgccataactctatagaatttgctcaagaaactgcaaaagtcctcgcaggtaatggctgcgaagttttcttgtttcagtatcccgaacctttggctttagtctcctttacggtgagatacgaaagggccatcggcggagtgatgatcaccgcctctcataatcctcccaattacaatgggtataaagtttatatggcttcgggaggccaagttctccctcccttagatcaagagattgttgccgcctgtagtgcagtgaacgaaattttatcagtgccctcgatagatcatcccaatattcacctcattggaaaagaatacgaagccctttacagagacactttgaagcaactgcaactctatcccgaagcaaaccggatttcaggaaggtctttatctatttcctattcgccattgcatggaacaggaatttctctcgttcctcatgttctcaaagactggggatttttatccgtacatcttgtggaaaaacaggccataggtgacggcgatttcccaaccgtgcagctgccaaatcctgaggatccagaggctctgactctgggcattgagcaaatgctcgctaatgacgatgatctttttatagctaccgacccagatgccgatcgcgtgggcgtggtttgtctagaagacggccaaccctaccgatttaacggaaatcaaatggcgagccttttagcagaccacatcttaggagcttggagcaaaacaagacacttaggagaacatgataaattggtcaagagcttggtgactacagaaatgctctctgctatcgcaaagcactatcatgtggatcttattaatgtcggaacaggatttaaatacatcggagagaaaattgaatcctggcgcaattccacaaacaaattcgtatttggagccgaggaatcttacggttgtctctacggcactcacgtagaagataaagacgctattattgcgtcagcattgattgcagaagccgcactacaacaaaaattacaaggaaaaactctatgcgacgcactcctttctctttacgaaacatacggatactttgctaacaaaacggagtctgtggttttttccgcaaaaactgacgaacaagaaataagaaaaaaactttcacaccttgaggaaatcagttctgcgaattttttctcagggaaataccaagtagagaaatttgaaaactataagcaagggataggtttcaatcttctatcgaaggattcctacgccctcaccctgcctaaaacatctatgctctgttattattttagtgggggaggtcgggtaatcatacgaccctcaggaacagaacctaaaatcaagttctacttcgaaatgtcaactcattatccagagcgcgttaccgataaagaaatacaaaaacaacgtgaagcagagagttttcaacatttagacgattttatttttgattttaaagagaaattttccaatttgtgagtggaaaaatcatcttggagaatatcctaaagctatttacacttgggctaaatctccttcagaataaggccttctttcaaggccattgttgtatccgaaacaaggttgagtagagtacttgctttcctagcaaaactttctgaacttaaatcaaggaggttaaatactaaaaaggtatgttgttatgagttttgttccttattctttaccagagttaccctatgattatgacgctttggagcctgtaatttcttctgaaattatgattttacaccaccaaaagcatcatcagatctacattaataatcttaacgcggctttgaagagattagatgctgcagaaacacaacaaaaccttaatgaactcattgctttagaacccgctctccgctttaacgggggaggacacatcaaccactctctattctgggaaactcttgctcctatcgatcaagggggaggacagcctccaaaacatgagctcctttctcttattgaaagattttggggtacgatggacaactttttaaaaaaattaatcgaagttgctgcaggagttcaaggctccggttgggcctggctaggattttgtcccgcaaaacaagaacttgtcttacaagcaacagcaaatcaggatcctctagagcctctcacagggaaactccctctgcttggcgtggatgtttgggagcacgcctattacctgcaatataaaaatgttcgtatggattatttaaaagcctttcctcaaataattaattggggacatatagaaaatagattttctgaaataatatcatctaaataatttgaatttggtgattttaattgcagtgttaataacattaatttaaaattgcttcctaacagaacctagattaggtggcttgtgcgtctattttcttacgacaaacccaagattaaagtgcaaaaaatcaaggcagatggttttagtggttggctcaagtgtaatcattgtcacgagatgattcacgcaaatgagctaggacaaaattataattgttgtcctaagtgctcctatcattaccgtattactgcgatcgaaagagtcaagctgcttgcagacaaagattcttggcgtcctctttatacggatctgaaatcccaagatcccttggaatttatagataccgatacctacgcaaatcgcctagaaaaagctcgaaagaatactacagaaagcgaaggcgtcattgtaggtatatgtactataggcctccaccccgtagccctcgccgttatggatttcaattttatggcaggatctatgggtgctgttgtaggggagaaactgaccagacttatagaggaagccattgaaaccaggctccctgtaattattgtcagcgcttctggaggcgcacgtatgcaggaatctgtattttctttaatgcagatggtgaagacctcagcagctcttgctaagcttcatgaagcaggtctaccctatatttcagtcctcaccaacccaacttcaggtggagtgacagcctctttcgctgccctcggtgatattataatagcagaacctaaagcactgatttgtttcgcaggacctcgagtcgtcgctcaggtgataggagaagatctccccgaaggggctcaaaaatctgaattcctactagaacatggcatgattgataaaatcgttgagcgtaaagaattgaaaaccacccttcagactttacttgattactttttagcccaagaatacactggcgggaaaagtaaagctcctagagatctttcgaaaaggcttaaagagatttttttgttgacagatgacagtgaataaaacatcataccgcatcttgcaatgataacattatctgtaacgctatccttatgactgtattttgtgaattggattcaggaggagaacttcctgaatatactacgccaggagccgctggtgcggatcttagggcaaacatcgaagaacccatcgctctgctgcctggacaacgtgctttgatccctaccggaatcaaagcagaaattcccgaagggtacgagctacaggtccgtcctcggagcggtttggctttaaagcacggcattactgttttaaattccccagggactatcgattcagattataggggagagattcgtgtaatcttaatcaacttcggtgatagtacattcattattgaacctaagatgcggatagctcaagttgttttatctcctgtagtacaggcaacgtttgttgttaagcaagaaagtttagcggaaactgcccgaggaagtggaggttttggtcatactggagcaagctaagatgccatcctattgtcaaaatcaacaagatttttctttattctctcttttgtctcctagacttgtaatgtttttaggcaaacactcccgagatgaaatcctccaagatcttacagatcttgtggatgctgcaggcctacttgaagacaaacaagccttttttgatgctcttgtccgtcgtgaaaacatcatgtccacaggaatcggaatgggcgtggctattcctcacggaaaactcgaaagctgctctaatttttttattgctataggcatccatacgcaaggcattttatgggacgctattgacggagccctcgtacgcctcgtcttcttgatcggaggtccagaaaatgctcaagccgaatatctcaagttattatctactttgactttatctttgagagaagagtctcgtcgtcaacagttgttacaggtgaatacgattgaagaagtcatgaatgtatttgtggggatgtaaaaatggatttaaagttagatgaagtcgcctctttgttagatgtttccgaacatacagttctgcaatggcttaaagaaggagccattccaagctatagtatgaataatgaataccgctttagtcgtgaagaaatcgaaaactggctattgcataaccaagcactcatgatccaagaacgcggcgaagataaagaagcacttaaagatctttctttgaaatatagtctctacaaagcaattcatcgtggcggcgtgctttgcgatgttgtggttcatagtaaagaagaagctctccaatacgcctctaaatacatcgcccaaaagtttcaattagacgaaagcgtactttttgaaatgctctcccacagagaaaatcttatgtccacaggtataggagaaggaattgccctgccccatgccaaagactttttaattaatgcctactatgacattgtggttcctatgtttcttgcagagcccatagaatacggggctctagatggaaaacctgtaggcattcttttcttcctttttgcttgccaggataaaagtcacttaaacttagtaaataaaatagtccacctcgggatgtctttaaatgcccgaagcttttttaaaaattatcctaacaaagatcaacttttagcgtacgttaaggaatgggagtcccaaactcattaatagctagagtttaaaaagatttttaagtccaagttgtgaaaaaaatccttttgttgctatggtgatcctcataggcttccaggagattgtagtcgcatgatgagctctaagcgtacctcgaaaatagcggtgctttcaattttattaacatttactcactctatagggttcgcaaatgcgaattcgtccgtaggtcttggcacggtctacattacatccgaggttgtaaagaagcctcagaaaggatcagaaaggaaacaagccaaaaaagaacctcgtgctcgtaaaggatacttagtcccttcttcaaggactctttcagctcgagcccaaaagatgaaaaactcctctcgtaaagagtcttcaggtggttgtaacgaaatttctgcaaattctacacccagatctgtaaaattacgaagaaacaaacgtgcagaacaaaaggcagctaaacaaggattttcagctttttctaacctaactttgaaaagcctacttcctaaacttccttcaaaacaaaaaacttcaattcacgagagagaaaaagcaacctcaagatttgttaatgagtctcagcttagttccgcacgaaaacgctactgcacaccatcttcagccgctccttccctatttttagaaacagaaatcgttcgagctcctgtagaaagaactaaagaacttcaagataatgaaattcatattcctgtagtgcaagtccaaacgaaccccaaagaacaaaatacaaagacaactaaacagttggcatcccaagcctcgattcaacaatctgaaggaaccgagcaatcattgcgagagctcgcccaaggtgctagcctacctgtcttagtgcgctctaatcctgaagtgtctgtacaaagacaaaaagaagagttattaaaagaactcgtagctgaacgtagacaatgtaaaagaaagtctgtaagacaagctcttgaagctcgttctttaactaagaaagttgctagaggcggttctgtgacctcgactttacgatacgatccagaaaaagcggcggaaatcaaaagtagacgcaattgcaaagtaagtcctgaagcacgtgaacaaaaatattcatcttgcaaaagagatgctcgcgctaatgggaaacaagacaagacaactcctagtgaagatgcttctcaagaagaacaacaaactggggcaggactcgtacgcaagactcctaaatctcaggttgcaagtaatgctcagaacttctaccgaaattctaaaaatacaaacatagatagctatcttacagctaaccaatacagctgtagttctgaagaaacagattggccatgttcttcctgcgtctctaaacgcagaactcacaacagtatatctgtatgtaccatggtagttactgtcattgcgatgatcgtaggggctttgattatagctaatgctacagaatctcaaacaacatcagatccaactcctccaactcctactccatagttgtatagcccttgctggacgtgtagctctacccaaaatcttagatagccttcttatctatgattttagtgggtagagctttccctcccgactcgtcttcttttcaattttctctttgtaattacactttatctctctttctatctttttcgggagtaccttcttattttagatagagaaagcttagtttttcttttgtttaagaaataattataagctcgttaatataatcaatttgcctttaagtaaaatgataaaactatctaatctatagtgatttgtgttgtatagcattattatattgcatcgtgtcagatttgcgtgttcattctaggggaacaccgacccagactcatagtgagatctgtgatgcccatcctaccaacagatttttgaaaaaacaccctacacttgacctatgtatgcgaattgtaagcacaattgtctctgtctttatgattttagcagacatcgttctcctcctgggctccctcttacttttacccctccttatagttttactttgggaatcttcttaggaagatgcctttctacgtctaatattgttttattataattttaaaaatgattataatttcttattaacttcatgaatatttacatttaataaaagtataatgtataattagttatgactaaaattcaatgtagtgctcagtattatagatctcgaccggccgagagggcccaaactcctccgcaacctttccttgctagggatcgcgcggatttttgggagagacatcctagattcagtgcatgttgtcgtgtcttattactcgttgcttgggtggttctcgctctactgtttctctttgttatgcttcttcctctagccgctgggtcgtatttacttgctttttaaggtattcttcacctaaaaacttgtgttttgggtgcctgtagctatttcaaaggcatgtttttatcgatcggagcttctctttgtttgggcgagtccgttcgtatctttgtaattcttctacgatttagttttatccttatcttagaccaacctcttcataggtggatcctgtagaggaactattcgactcaggagtcgtagacctaaggtattcgtgtttaaagataaaagttttattttctaagagttttttaattattaagatttttatttaaaaatatatcttttgattagatctctaatacgattattataaatataatatgtttttcaaaaaaaattatatgacagattttcctactcacttcaaaggacccaaacttaaccccattaaagtaaatccaaacttttttgagaggaatcctaaagtcgcaagggtactgcaaattacagccgtagtcttaggaatcattgccctcttatccggtatagtactcattataggcacccctctcggagctcctataagtatgatcctcggcggatgtcttttagcttctggaggcgccttatttgttggtggtacgattgctacgatattgcaagctagaaatagttataagaaggccgtgaaccaaaagaaactctcagagcctttgatggaacgccccgaattgaaagccttagattattccctagatctgaaagaggtatgggacctacatcattctgttgtcaaacatcttaaaaaattagacctgaatctttccaaaacccaaagggaagttctaaatcaaatcaaaattgatgatgagggaccctccctaggggaatgcgccgctatgatttcagaaaactacgacgcatgcttaaagatgctcgcgtatcgtgaggagctcctgaaagaacaaacccaataccaagagacacgattcaatcagaacctcactcatagaaataaagttttgctctccatcctctcaaggatcacggacaatatttctaaagcgggcggggtcttttctttgaaattttccacgctaagctcgcggatgtcacgaattcataccaccaccactgtgattctggctttaagtgccgttgtttctgtcatggtcgtagcagctctaattccaggtggcattttagcactacctatacttttggctgttgctatttctgcaggagtgattgtcaccggactttcctatctagttcgtcagattttaagtaacaccaagcgtaatcgtcaggatttttataaagattttgtaaaaaatgtagatatagagcttcttaaccaaacggtaactttacagcgattcctctttgaaatgctcaaaggtgttctgaaagaagaagaagaagtctccttagaaggtcaagattggtatacacaatacataaccaatgcacccatagaaaaaagattgatcgaagagatcagagttacctacaaagagatcgatgctcagaccaaaaaaatgaagacagacttggagttcttagaaaatgaggtgcgttccgggagactgtctgtagcgtccccgtcggaagatccaagtgaaactcctatttttactcaaggtaaggagtttgcaaagttacgtcgccaaacctctcagaatatatccacgatttatggtccggacaatgaaaatattgatcccgaattttccttaccctggatgcctaaaaaagaagaagaaatagaccatagcttagaacctgttacaaagttggaacccggttcaagagaagagttgttgttggtagagggggtcaacccaaccttaagagaactcaatatgagaattgcacttctacaacaacaactatcaagtgtccgaaaatggagacaccctcgaggggaacattacgggaatgttatctattcagatacagaactcgatcgtattcagatgctagaaggcgcattttataatcacctcagggaagctcaagaggaaatcacccagtctctcggagaccttgttgacattcaaaaccgtattttagggatcatagttgaaggggactcagattcaagaacagaagaagagcctcaggaataggattctcatataaataacaacaaactaagagctgtttttttctcttacagctctttctagacaggatctctaaggtcctaaattcatgttttccattatcatccttgcctacgacctaggctgcatccggattctataagtacgtactctcagttgctttttctacaagttgggctagcccacaggctgcaaacagaaattttatttcttgaaatctattttcttatttacaaatttatttccctaaaatgaataaactaaggagtttatatggcaaatcccacacaatcgcgaccaccgagtccggagataagtatagaagaactagagcttcaagaacttgcaggatcctcgaatactgagactatttctaatacacctcccccgtcatgcgctgctactgccgaagaagtatctctttttattgagggaggccgtagaaactcagaagatgaggagggacctctaggatcttgtgaggtgtacgatgttgtctgtataacaaaccaaggagatcctgaggttagagatcacgaagtcagagttatgtacattaacggcagcggtcgaacacaacatgagggtattcttgatgctatgaacatctgtgatctcagaggagaacccgtcaggttcatacacaatagtgggtatggtttagggagctgcttcttagggattcgaaatcgtattcctcctagagataatgttattagccaagcaatacaagcacgatggaatgagttttttattttcgcagaaaatgcaaatcgagattacatcgttcttttctctggtaatggaggtctctatcttcaagtcgctttagataactccatatactcacatcatattctttgtgttggcattggaagcagttattatatccaaggaaattatcgtgttcacaactaccgtgtgacaggggattggacgaccctcctggatcgtcggggggcaacagcagtaaatactacaacgttgccttatgcagattctgctgaaggactctttttaccctcagtacgctgtccctcataccaatgggcattgcgttgtggagaacagtgcctgatcatggataacaaccaacaagttgggtttcgcccccaagattcctcttcagaaatcgccttagtagtaaatttaaatcaggaccacagcacctggactcgtctgattgaatggatagatcggggggattctcaggctgttctagaattgaatcctcaaccgagtcattgtcgtgatattgcattgactgcactatacgctacaacaaggatttcttctttacttcaagagtgcctaatgatttctgtgacttatgctccagaggttttcgtcacctatgctatcgttacaggatactctataatgaccttgcgctattttattctattattaacaaatcgtccaggctgccggcggcattttcgtgttttaagattagcggctttagggttgcagtccttaggatttttgactgtattgcttgatcatatcaatgtaacacggagagtcaatcgccgcccccccttaatatcagtaatcttctgtactgctagttttgccacaggaagtttcatttatgtagacttaacacgcatgtttttcacgagcttacgttcgcgcttgcaattgtttgttcaaagaagattaacaggaagaggtctaccactgagaagggtttttgtaaatcacctagactctttgagattttctcaaaatgctttgataacctttcatgggggactttttatgcctctcataataggtttttttaatcagctggtcattcaggttcctcgagttgtcatcagaccaaataccactgccgtttatgatctcaaccagacctcacaggaagcgtgggactctggagacgtattagctataggacagaccataaacttcttgctttgcatgattctattggtcatcaatacctttttcttcgtgagatccgtacgaaggaatttgcatcgtagacctcatcgatagcaactgtgcagaaccctactctttagatttcaaaaataactgataccgaaatgcccctgtactataggtgccattgttccttagaaatctaaagagatcggcctctttcctttatatctgaaatcatgactaggaataaggagtttactgtctttaaacgcatctcgttgacattaaaaccaaataaaaacatgtttttatttggtctattctgttaaaatagataggttttttttaactctgatcctaaagtgtcattgaaaaggttcagggtattcttatagaggtccccctatggcagtagaaggaagagtaaatagttctcaagccttaaatcaagattgtcaagaagtcttagcaaataaacaatcgaaaggcctcctaaggtgcagaattctatctatagtagtagctgttatcacctttatcgccggggttgtgttgatagctttaacattagcctctattttaacttctgttccctacttagcgttaggagtgtttttactgattgtcactctgggatgtataatatttgctctttgctctgagaaaataaaaaaggttcccccgactcctatttcacataaagaggagatcattgcctggttcgaagaaagaaaaaatattgatatggaaaaggaaaaagaagatccggagcattttggaagaaccgctacggatatcccaatgagatctgcattagatcagtttaaccactcttgtcaccatattcacgagagccccgcgttaacagaaacttatagaagccatcaagatgttctcctctttaaggactggtgtcctgttacgttgcctgatgtaacctcagaagaagaagtcttaatacgcagtgtggttggtagctatttattaatggaggcgtgcgttccaaaagtatccatgcttatcgacgaactccataataagcttaaatctccttccgaaagagagtgcctctttatagataaaaaaacattgcagcgaaaagctagttttcttttcactcagaaagatctcgcaacattctttcttgcttatacgcgggtgaatgatggtcatttagcaccgtttcgagcaggagcaaaatggatcttaatacattacgttaggttaagacgtcaacacaatcagaacgacttttttactccaggacattcttgttactatgctcgtctagcctttaaccaaacccaacgactctatcatcaattattcaatgtagaaaagcttcgtagtatctatgcgaacatggataaagaccctctatgtcacccatgggctttcattcctatctatgatttattgaaaacagaggaccatggagatggttttctagaacaacaagaagatcgggaatatccaagtagagctgctcaagatcaattttggggctaatgtttaaaggatcagttttttaaaacacggattctaaattgtaattcaggattactatttttcttcagaaagcttagacctactgcttgtgaggcaggggagtattcttacaccccaaaggaaatataccgaataaaaatatctagaagaggctctagatacatctttggaaatagactctccgttcttagatactctagattatctaaatttcatgaggagagatcaaaagaaaatgttccaagatgttatggaacattttctctctagtttatttttttaatagcataagagtttgtttaatatcttgttcacgttgaaatgctagctcgcggcttactttttctttattccaatctaaaatggactttttaaactctaaatccttctctcggagctctaattcgcgatttttcaactccaattcgcggttccgaatgtcaaattcacgattaaaacaatcgataatttgggcaacttgtccagattgacacatcttagaaatgccctctaatctttgaaccatgctatcgaaaaaatctaagacatattcattagaagactctttatcagtcttttcagaaagaccttctgagtcagaagtaccacaactttcctcaatctcttccgaacttttttgcccgtcggaaattgcttgtagttcattacgtatctctttgccctcttcgattggggtttcaatcagctcattgagttgtgttattaaaacttcaggatcctcctcaattctggactgagaagagacatcctcattgcaaatgccttttaggggagcggagaaactgcaggagaaaattaaactataaataaaaaatttcttaatcataaaactttaaagtaattaatttaataaatcgattttaatggtattatagaaatataaaaatcaaaatacaaaagaaatttgtgaataaaaaaaagaatagcaaattattttttgttcatgatttgtgaattttaaaaaatattatttattaaatacaaacctgttaacaataggttgtgaaaggagattacgatttttttgagatatccttattaactacaaaatggtcttacctatattaggttaattaaaataatataaattatttatgtgttattgatttataattaaattttctttatgtttatctactcatatttaatcttggtataatgacaacacccccaccatcccgatcctcctctcctcctccctatgattggatagaacttcaagatctggggaatacgaataacaatagcagtcgagctaccccccccccccccgaagtaggcggtgagctgcccccgtatttttcagctagcaactttgttgtaatagagcggggcgctcctagtctgccttctccacagcaacttttatctcttccagaatattctaggcagccgccaccaggatattttgatgaaacagcaagcataactagcagaacgagtgaagagatgtttggtaccttggtctctaccttgtgttgtcctgccaactcggaaagggattgggaagatcacgaggtaaattgtatttatattgctagtaccagtgacactcaacttgaagctgttcaaggtgggatgcatatcactgagttacgtggtgaacccgtaagagttctttatgagacgggtcacttatacgcatttgctagagaaaatacatgtcattcccgtttagaagttagccatacagttagagctatgacgtacttttgggaccgattttttagtcgccactggaacgtggggcgacgtttcctagtattttaccagggaaacggaggcgcctatgttcaggcagccctcgattcatccatgcatactcaggatatctatgttctagggctctctccgactgtctatattagagggaactatcacgtacagcactaccgtgttcgaggattttggccctcttgcctggattctctagcggcctgtgcggaaaatacatcagtacttccctacggggaatcgagtgacggaatcttttacccctctctattcagccacacatttgataacgcgatacggtatggtgagagatgcctgttggtttgttctgagggcatgggaatgcttccagaaacgcaacaacaaacatctcctttaacttcactagaagggggacatgaggtagctctagttctcaatccccagcagaacccagaggctctaagtattgcctctagattgatgcatgaagaaagaggtgggagattagaatctaactatatgcctggacgttctagtaatcctttcatgacaagtatgtatgttctcgtacggctgaatacacttgctcagatctacctgatgtctccttattattctttccaaagcaacgacattgtatgccttatctttataagcagtgctgctgtagagacagtaagctacatattcctgactgtaactgactcaacttgtgggcgtcggtacctgcgtgtcccacggctagtttgtacagggttacgtaacctggcgttacccacaactctactagagctacttattttgtcataccctcgatcagtagagggggtacctttcaatgttagattcattcttggatatatgtgcactactagagttgtattttttgcatggaacttgatcctccactggcctttccgatgtctacgccatggaatccaattgtttgttcatagaagtataataggacatacgttgggagcaagaattactgatttaaccctagcaagtatgcgatacgcaatagtgtttccatctatagtaagttcatgcttgttaactgctcttgctcatgcaaatactaacatacttgccttggacccttatagattgatcgaatctggagatttaagacgtcccgcatttaatgatgatgaaatgcaacaagcagataatccttgggatgcttactctatcggcttagttataaacacgtgtatctacatgttaattttattcgcaaacctaattttcatggtgtactctgtacgaagataccatagatcccgccgctaagagtagcttgccttaagtttcgtactatctattcttcggcaatgcaagataagaaaacattgattaagagcgaatagaaccctaaaaaactgtgtttattttttattacagttttttagatataaagatctctttttagttccgtatctctaaatgaaatcaaaagggttccttgtgaagaaaaccctacagattgcaaccgaagaatagactcgaaatgaggggacacctttgggaatctctgttcgtaggtgcgtgactgattagaaaaaaagttttgatttttcaaatgaaataagcctactttgtattagaggctgattcataaactttcctaagaaatatatgataagaaaaacttggggcggacaggatttgaacctgtgacctacgggttatgagtccgcagctctaaccactgagctaccgccccccaaggtaagagagcaatgctaacacataattttctaatgatcaagggatatccacgcctgaacggaatgtagttatgtttgaggcggctttaagtattgtaccgctatttgcttcatacgcatgtacagagattctccaccattcaacctaccaaaagaaagatagggagtcaggcgctgaaaaaaaattggcttgcatgtcaaaattgtagaaggagtttctccagaatatacctcagtaaataaagaggcgattcctgaagacattaaagctttcgtataagtgaaaaaaaataaaattccatcttgatatacctcgtaaagatataaatcactctgacaacctacaaccaagttctccttcaacatgcgcttcttgtcaaaagcatcccttgaagaactattttccatcaacttaagatacagatgatctttttgaaaaggttctggaaatagctcctcaataattttatgctgtttttttaaacacctagcgtgttgcagaggacagataaattccaaaatacttctcaatgatttgattcaatgatacgatcaggctcttttttgatttgttgcaaagtctgagataaggtcataatacattggtcagctcttgcaataatatcatcaggactgttgttattcaagtcaaggtatgagctagttacaccacattctggcatcgaaaaacaatagggcataggctgatttaagtttagtttcaaagaagctaaaagattcgctgtggcaggatccgtttggttgttgcgatttatctctataagcgcattcaactgcttttgattgatcatttggtgcttgatgatttgatgctggttgatcgcttgctcaatgttctctattcgttttttgtgggccttgcgatcaatagcataagtagcctcatctcctaagcgcgccccataaacagtattaatacttaattgatttccaatggaaaaacctataacaagaccaacagcctgaggaaccgcataaatcaacgctgaaatagaggctatcatcgtggctaaaagaatttgtcgtgttccgttcggatctaattgcaaaattccatggtttatcaaattccatagactgtttacatgcctatgcttgttctctttatctaaacatgtcgctgtaaaaatgccaaaaacaacgccaatccctagacccacccctaaccaaattgttagagttaaagcaaccgtatgatgacatactaaaattaatgcccaagctaaaatataaagtaatatatatttccaattcctttggaggaataaaccaattttttcaaccgcgttttttaaacgagttgtccaagaaaatgaattttgattataaggaactaatttcagatcagttaatgcaactaacgctgaaataggagggctgactataggagagtcccctgaagcatttgaatcaggagagttcgatctagaagagctcagtctgtcacaaaatagttcttgaggaacgtattggtcagaaggcgaaattcctccagaagatagtggagtagacattcgatagtgaaaaaaataaaacaataagcagtatattaaaataaggactttttctttgtaaacagaggtttttgtgcttctatagcccctctagtttactcaatattttattggtagtattcgcaaggttttgtgaaagggatttgactttttctaaataacaaatataatcctaatgcgtttatagaataggggaaatgaagagcaccgttctatttttagggctgaatctacccactaggccagccagtcacaggcttaggcttaaaagattttgttaaggataattgatcaatggcgaaaaaagaagatactcttgtactcgaaggtaaggtagaagagctccttccaggaatgcattttcgtgtaatactagaaaacggtatgccagttaccgcccatttgtgcggaaaaatgcgtatgagtaatattcgattgcttgttggagaccgcgttactgtcgagatgtccgcctatgacttaacaaaagctagggttgtctacagacatcgttaattatattttctattgatgttttaaaataagtgacatagactaggcggtttttcaagaccgggaagcaatgcataagtaagcccagatagctcagtggtagagcacttgcatggtaagcaagcggtcgtaggttcaattcctattctgggcagaaagaatggttggagtaatcaataatttttaagaggattttgagatgtcaaaagaaacttttcaacgtaataagccccatatcaatattgggacgatcgggcacgttgaccatggtaaaactacgctaacagcggcaattacacgcgcgctatcaggggatggattggcctctttccgtgactatagttcaattgacaatactccagaagaaaaggctcgtggaattactatcaacgcttctcacgttgaatacgaaaccccaaatcgtcactacgctcacgtagactgccctggtcacgctgactatgttaaaaatatgattacaggcgccgctcaaatggacggagctatcctagtcgtttcagctacagacggagctatgccacaaactaaagaacatatcttgctagctcgccaggttggagttccttatatcgttgttttcttgaataaagtagatatgatctctcaagaagatgctgaacttattgaccttgttgagatggaacttagtgagcttcttgaagaaaaaggctacaaaggatgccctattatccgtggttctgctttgaaagctcttgaaggtgatgcaaattatatcgaaaaagttcgagaacttatgcaagctgtggatgacaacatccctacaccagaaagagaaattgataagcctttcttaatgcctatcgaagacgtattctcaatctctggtcgtggtactgtggttacaggaagaatcgagcgtggaatcgttaaagtttctgataaagttcagctcgtgggattaggagagactaaagaaacaatcgttactggagtcgaaatgttcaggaaagaacttcctgaaggtcgtgcaggagaaaacgttggtttactcctcagaggtattggaaagaacgatgttgaaagaggtatggtggtttgtcagcctaacagcgtgaagcctcatacgaaatttaagtcagctgtttacgttcttcagaaagaagaaggcggacgtcataagcctttcttcagcggatacagacctcagttcttcttccgtactacagacgtgacaggagtcgtaactcttcctgaaggaactgaaatggtaatgcctggagataacgttgagcttgatgttgagctcattggaacagttgctcttgaagaaggaatgagatttgcaattcgtgaaggtggtcgtactatcggcgctggaacgatttcaaagatcaatgcttaaaaatgaatttcgcgatgattttcatcatcgcgattttctgggtgtgtagcttagctggtagagcagtggcctccaaagccgccggtcgggggttcgattcccttcgcacccgtagatttaatttttaatctagaagttggtttatgaaacaacaacacaatcgtaaggctttatctcgcaagattggcacagtgaaaaaacaagccaaatttgcaggaagctttttagatgagattaaaaaaattgaatgggtaagcaagcacgatcttaagaaatacataaaagtagttcttatcagtatttttggttttggatttgctatttatttcgtagatcttgtgttgcgtaagtcaatcacatgtttagatggtataacaacctttttgttcggttaattgcatgtataaatggtatgtcgttcaagtttttacagctcaagaaaagaaagtaaaaaaggctttagaagattttaaagagtcttcaggaatgactgattttatacaggaaattatcttgcctattgaaaatgtcatggaagtgaaaaaaggagaacataaggtcgttgaaaaatacatctggcctggatacctcttagttaaaatgcatctgactgacgagtcttggctctatgttaaaagtacagcaggtatagtcgagtttcttggaggcggagtccctgtagctctttctgaagatgaagtaagaagtatcttaacagatatagaagagaagaaatcgggagtggtgcaaaaacatcagttcgaggttggttctagagtgaaaattaatgacggagtctttgtcaattttatcggcatggtttccgaagttttccatgataaaggacgcctgagtgttatggtttctatctttggaagagaaactagggtagatgatttagaattttggcaagtggaagaggtagccccagggcaagaaagtgagtagataggttaaaatcagtgtattcttattccttatcttcttataattttagtttttcgtttcttaccctctgtttgtagaggtgtctcagtgcaaagtaaggtttagtatgtcggtaaaaaaggtaatcaaaataattaagttgcaaatccctgggggtaaagcaaatcctgcgccacccataggaccagctttaggtgctgctggagtcaatattatgggcttctgtaaggagtttaatgctgcaactcaagataagcctggagacttacttccagtagtcatcactgtttatgctgataaaacttttacttttataaccaaacagcctccagtctcctctttaataaagaaaactttgaatctggaatcaggatctaaaattcctaatcgtaataaagtaggaaaacttactcaggctcaagttgaagcaattgctgaacaaaaaatgaaagatatggatattgtccttctagaatctgcgaaacgtatggtggaaggaactgcccgtagtatgggtatagacgtagaataaattgttacttgtagagctgtagaattatgacaaaacatggaaaacgtatacgaggcatcttaaagaactatgatttctcaaaatcatattctttgcgggaggctatagatattttaaaacaatgtcctccagtacgcttcgatcaaactgtagatgtatctatcaagttagggatagatcctaaaaagagcgaccaacaaattcgtggagccgtttttttacctaatggtacaggaaaaactttaagaattttggtttttgcttcagggaacaaagtcaaagaagctgttgaagcgggcgcagactttatgggaagcgacgatcttgttgaaaaaattaaatccgggtggctggaattcgatgttgctgtcgctaccccagatatgatgcgtgaagtaggaaaattaggaaaagtcttaggacctagaaatctaatgcctacacctaaaacaggaacggtaaccacagacgttgctaaagcaatctccgaattgcgtaaaggaaaaattgaatttaaagcagaccgcgcaggcgtatgtaatgtaggcgtaggtaagttgtcttttgaaagcagtcaaatcaaagaaaatattgaagctctaagttctgctttaattaaggccaaacctcctgcagctaaaggtcaatatttagtctcattcactatttcttccactatggggcctggtatttctatagatactagagaattaatggcatcttaatcttaaagagggaaaatgaaacaagaaaaaacattacttcttcaagaggtagaagacaaaatttccgcagcacagggattcattttattaagataccttagatttaccgccgcgtattctagagaattcagaaactcactttctggagtttctgcagaatttgaagttttaaagaagagaatcttctttaaagctatagaagctgcaggtttagaggtagattgtagtgatacagatgggcatctcggtgtagtcttttcctgtggagatcctgtttctgccgcaaagcaggtactggactttaataaacaacataaagactctttagttttcctcgctggaaggatggacaatgcgtctctgtctggtgcagaggtagaagctgtcgccaaattgccatctcttaaagaacttagacagcaggttgttggtttattcgctgctccaatgtcccaagttgtaggaattatgaattctgtcctttctggagtgatctcctgtgtggatcaaaaggcaggaaagaactaaagaattaaaattaaaactctcaaaataagtaagggtgacaaaagtgacaacagaaagtttggaaactttagtagagaagttaagtaatttaactgtactagaactctctcaattgaaaaaattattagaagagaagtgggatgttactgcttctgctcccgtagttgctgttgctgctggtggtggcggagaagctcctgttgctgccgaacctacagaatttgcagtaaccctcgaagatgttcctgcagataaaaaaatcggcgtcttaaaagtcgttagggaagtaactggattagctttaaaagaagctaaagaaatgacagaaggtttacctaaaactgttaaagaaaaaacttctaaaagtgatgctgaagatactgttaagaagttacaagatgctggcgcaaaagcctcatttaagggactgtaatttgtagaaaagaaaaatcgaaagatttttcttttctttttcttttcatgtataaaaaaccgaatgctccctttagaagcatacgtaggcttaatttagggaaattttgtcgcatcaaaatagcaggagaactcgcatgttgaagtgccctgaacgggtcagtgttaaaaaaaaggaagatatcccagaccttccaaatcttatcgaaatccaaattaagtcttataagcagtttcttcaaattggaaaattagcagaagaaagagaaaatatcggtttagaagaggttttcagggaaatttttcccattaaatcctataacgaagctaccgttcttgagtacctttcatataatttgggtgtgccaaaatattctccagaagaatgtatccgtagaggaattacctatagcgtcactttgaaagtccgttttcgtttaaccgatgaaacgggaatcaaagaagaagaagtctatatgggaacgatccctctaatgactgataaagggacatttatcattaatggagctgaaagagtcgttgtttcccaagttcatcgttctccaggaattaactttgaacaagaaaaacattccaaaggtaatattttattctccttcagaatcattccttatcgtggaagttggctcgaagctattttcgatattaatgacttaatttatatccatattgatagaaaaaaacgtagaagaaaaattctagcaatcacctttatccgagctcttggatactcttcagatgcagatatcatcgaagaattcttcacaataggagaaagttctcttagaagtgagaaagactttgctcttcttgttggaaggattttagcagacaatattattgatgaagcctcctctctagtttatggaaaagccggagaaaagttaagtacagcaatgttaaaacggatgctcgatgctggaatcgcttctgttaagattgctgtagatgctgatgaaaatcatcctattatcaaaatgctcgctaaggatcctacagattcatacgaagccgctttaaaagatttttatcgtagactacgtccaggagaacctgcaactctagctaatgcacgttctactatcatgaggctcttctttgaccccaaacgttataatctaggacgtgtagggcgttataagctcaatcgcaaactaggcttctctatagatgatgaagctctgtctcaagttactttgagaaaagaagatgtgatcggagccttaaagtatctgattcgtttgaaaatgggagatgaaaaagcttgtgtagacgatattgatcatcttgctaatcgacgtgtccgctctgtcggagaactcattcaaaatcaatgtcgttcaggacttgctagaatggagaaaattgttagagagagaatgaatttattcgatttctcctcagatacgttgactccaggaaaagttgtctctgctaaaggtctcgctagcgtgttaaaagatttctttggccgctcccagctttcgcagtttatggaccaaaccaaccctgtagctgagttaactcacaaacgacgtctttctgcattaggtccaggaggactaaatagagaacgcgcaggatttgaagttcgtgacgtgcacgcaagtcattatggacgtatttgtcctattgaaactcctgaaggtccaaatattggtctgatcacctctctttcctcttttgctaaaattaacgaatttggattcattgaaactccttatagaattgtaagagatggaatcgtaacagatgaaatcgaatacatgacagccgatgttgaagaagaatgtgtgattgcacaggcttcagcaagcctagatgagtacaatatgtttacggaacccgtctgttgggtacgttatgctggagaagctttcgaagcagatacaagcaccgtaacccatatggatgtttctccgaaacagctcgtttctattgttacaggattgattcctttcttagagcacgacgatgcgaaccgcgccttgatgggctccaatatgcaacgtcaagcggttcccttacttaaaaccgaagctcctgttgttggcactggattagaatgtcgtgctgctaaagattctggagctattgttgttgcagaagaagatggtgttgttgattttgttgatggttacaaagtagttgttgctgcaaaacataatcctacaattaaacgtacctatcatctgaaaaagttccttagatctaattcaggaacttgcattaaccaacagcccttgtgtgcagtcggtgatgtcataactaagggtgatgtgattgctgatggacccgcaactgatcgtggagaacttgctttaggtaaaaatgtactcgttgcctttatgccttggtatggatacaactttgaggatgcgatcattatctctgaaaaattgatcagagaagatgcctatacctctatttatattgaggaattcgaactaacagcccgagatacaaaattaggaaaagaagagatcactcgtgacattcctaacgtatctgatgaagtattggccaatctcggtgaggatgggatcattcgtatcggtgctgaggttaaacctggggatattcttgttggtaagatcacaccaaaatcagaaacagaattagctccagaagagcgtctgctccgtgctatttttggtgaaaaagctgctgacgttaaagatgcatctttaacagtgcctccaggaactgaaggcgtcgttatggatgttaaagtcttcagtagaaaggatagattgtcaaagagtgatgacgaacttgtagaagaagctgttcatcttaaagatttgcaaaaaggatataaaaaccaagttgcaactttaaaaacagaatatcgtgagaaattaggagctctcttattaaatgagaaagcacctgcagccattattcaccgtcgtacagcagaaatcgttgttcatgaaggcctactctttgatcaagagacaatagaacggatagaacaagaagatttagtggatcttttaatgcctaactgtgaaatgtatgaagtgttgaaaggacttctatcagattacgaaacggcattacaacggctagaaatcaattataagactgaagttgagcatattcgtgagggagatgcagatttagatcatggtgtcattcgccaagttaaagtctacgttgcctctaagagaaaacttcaagttggagataaaatggctggacgacacggaaataaaggtgttgtttccaaaatcgttcccgaagcggatatgccatatctctctaacggagaaactgtacaaatgatcctgaaccccctcggggtgccttcaaggatgaaccttggacaggtattagaaacacacctaggttatgcagcaaaaactgcaggcatttacgtgaaaacccctgtttttgaaggattccctgaacaacgtatctgggatatgatgatagaacagggattaccagaagatgggaagtccttcttatatgatgggaagacaggtgaacgctttgataacaaggtagtgataggctatatctatatgctaaagctcagtcacttgatcgctgataagattcacgcaagatctatagggccatattctttagtcacgcaacaacctctcggtggtaaagctcagatgggaggacaaagattcggggaaatggaagtttgggctctagaagcatatggggttgctcatatgctccaagaaattctaaccgtgaaatctgatgatgtctcaggaagaacaaggatttacgaatctatcgttaagggggaaaacctcttgcgatcaggaacgcctgagtcgttcaatgtgctaattaaagagatgcagggtctaggacttgatgttcgtcctatggtcgtagacgcttaaaaaatgacgttttggagaaaataatgttcggagaaaattctcgagacattggagttctttctaaagaaggactatttgataaattagagataggcatagcttcagatattacaattcgtgataaatggtcttgtggagaaatcaaaaagccagaaactataaattaccgtacgtttaaacctgaaaagggcggtctattttgtgaaaaaatctttggtcctactaaagattgggaatgttgctgcggaaaatataaaaaaataaaacataaaggaattgtctgcgatcgatgcggagttgaagttactctttcaaaagtccgtcgtgaacgtatggctcatatcgagttagcagttcctattgtccatatttggtttttcaaaacaactccatcacgcattggtaatgttcttggaatgacagcttcggatctggaacgtgtcatttattatgaagaatatgtagttattgacccaggtaagacagacctaactaaaaaacaacttcttaatgatgcgcaatatcgtgaagttgttgagaagtggggtaaggacgctttcgttgctaaaatgggtggcgaagctatctatgatttgcttaaatccgaagatctccaaagcttgcttaaagatcttaaagagcgtttacgcaaaacaaaatctcagcaagcgagaatgaagttagccaaacgtcttaaaatcattgagggatttgtttcttcatccaaccacccggagtggatggtattaaaaaatatcccagtagttccacctgatctccgtcctcttgttcctttagatggcggtcgttttgcgacttctgatttaaacgatctctaccgccgtgtaattaatcgtaacaatcgtcttaaagcgatcttacgtttaaaaacaccagaggttattgttcgtaatgaaaagcgtatgcttcaagaagctgttgatgctctttttgataacggtcgacatggtcatccggtcatgggagctggaaaccgaccattgaaatccttgtcagaaatgttaaagggaaaaaatggacgcttccgtcaaaatcttttaggaaaacgtgttgactactctggacgttctgtaattattgttggtcctgaattgaagtttaatcaatgcggattgcctaaggaaatggctttagagctattcgaaccctttattattaaaagactaaaagatcaaggcagcgtttataccattcgttctgctaagaaaatgattcaacgaggagccccagaagtttgggacgttctcgaagagatcattaagggacatccagtacttcttaaccgagcacctacattgcaccgtttaggaattcaagctttcgaacctgtattgatagaaggtaaagcgattcgtatacaccccctagtttgcgcagcgtttaacgctgacttcgacggagaccaaatggccgtgcacgttcctctatctgtagaggcacaactggaagctaaagttttaatgatggctccagacaacatcttccttccttcctcaggaaagcctgtggctattccttcgaaagatatgactttaggattatattatctgatggcagatcctacctattttcctgaagaacatggaggaaaaactaagatatttaaagatgaaatcgaagtattgcgtgctttaaataacggtggattcattgatgatgttttcggagatcgtcgtgatgaaacaggacgcggtatccatattcatgaaaagattaaagtgcgtattgatggacaaattattgagacaaccccaggaagggtattgttcaacagaattgttcctaaagaactcggcttccaaaattacagcatgccaagtaagcgtataagtgagcttattttacagtgctataagaaagtcggtttagaagctactgtacgtttcttagatgaccttaaagatcttggatttattcaagctacaaaagccgcaatctctatgggattgaaggatgttcgtattcctgatatcaagagtcatatcctcaaagatgcctacgataaggttgctatcgtcaaaaaacaatatgatgatgggatcattactgaaggggagcgtcattccaaaactattagtatttggactgaagtttccgaacagctttcagatgccctctatgttgaaattagcaaacaaacacgtagcaagcataaccccttgttcctgatgattgattctggagcccgaggtaataaatcccagttgaaacagttgggagcgttacgaggattaatggcgaagccaaacggagcaattattgaatctccaattacttcgaactttagagaaggattgacagttttagagtactccatctcctcacacggtgcgagaaaaggtttagccgatacagctctaaaaactgccgactccggatacttaacacgtagacttgtagacgtagcccaagacgtgatcattaccgaaaaagattgcggtacgttaaatcacattgagatttctgcaataggtcaaggttctgaagaactcttgcctcttaaagatcgtatctatggacgtactgtagctgaagatgtctatcaaccaggtgataaaagtcgactacttgctcaatcgggtgatgtactcaactccgtacaagcagaagcaattgatgatgccggtattgagacaattaagattcgttctacattaacgtgcgaaagtcctcgcggagtttgtgcaaagtgttacggcctcaatttagctaatggtagactcattggcatgggtgaagctgttggtattattgctgctcagtcgattggggaacctggaactcagttaacaatgagaacgttccacctagggggtattgctgctacgtcttcaactcctgagattattacgaatagtgatggtatcttagtctacatggatctccgtgttgttctggggcaagaaggtcacaatcttgtcttgaataagaagggagctttacatgttgtaggtgatgaaggtcgtactctcaatgagtataaaaagctgctttcaaccaagtctatagaaagcctagaggtatttcctgtagaactaggagtgaaaattcttgttgctgacggaactcctgtttctcaaggacaaagaatcggagaagttgaactacacaatattcctatcatttgcgataagcctggctttattaaatatgaagatttggttgagggaatctctacagagaaagttgtgaacaagaacacaggacttgttgaacttattgtgaaacagcaccgaggggagttacatcctcagattgctatctatgatgatgctgacttgtcagaacttgtcggaacctatgcgattccttcaggagcgattatctctgtagaagaaggacaacgggttgatccaggtatgttgttagctagacttcctcgcggagctatcaaaacaaaagatattactggcggtttgcctcgtgttgctgaattagtagaagctcgtaaacctgaagatgctgctgacatcgccaaaattgatggtgttgttgacttcaaaggaattcaaaagaacaaacgtattcttgttgtctgtgatgaaatgacaggtatggaagaagaacatctgattccattaaccaaacatttgattgtacaacgtggagatagtgtgattaaagggcagcagcttaccgatggtttagttgttcctcatgaaatcctagaaatttgcggagttcgtgaacttcagaagtacctggtaaatgaggtgcaggaagtttaccgtctgcagggcgttgacattaacgataagcatattgaaattattgttcgtcagatgttacaaaaagtacgaattactgacccaggtgatacgactctgctctttggcgaagacgtgaataagaaagagttttatgaagaaaatcgtcgtaccgaagaagacggtggtaagccagctcaagctgttcccgtcttattgggaattacgaaagcttctttgggtacggaatcgtttatatcagcagcttctttccaagacacaactcgagtcttaacagatgcagcttgttgtagcaaaaccgactaccttcttggatttaaggaaaatgtgatcatgggtcatatgattcctggtggtacaggctttgaaacgcataagcgtattaagcagtatctagaaaaagaacaagaagatctcgtttttgattttgttagtgaaacagagtgtgtttgttaactaggtgacacagtcttttatcaaggaggttatgtttacaacctccttgataggaatgttttttttgttaacgttgcctagagatcaacagtgatgccaaggtgcctatgtctaaccaatttgatcaattaaagaagttgagcactatcgtttgtgatagcggagacccagagctagttaaagcctcgggatctcaagacgctacaacaaacccttctttgatcttaaaagtggcccaagaacccaaatttcaagagctattaaacgaagctgtagtttggggaatccgacagaacggtgatgatcttcagactctttcttttattttagacaaaattcaggttaactttgctctagaaattatcaaaaatatccctggtagaatttctcttgaaattgacgctaggctttctttcaacgttgaagctatggtacagcgtgccgtattcctttcgcagcttttcgaagctatgggaggagataaaaagcgcctgttagtaaagattcctggaacttgggaaggtattcgagctgttgaatttttagaagcaaagggcatagcatgtaatgtcactttgatttttaatttagttcaagcgattgcagctgctaaagctaaagcaactttaatttctccttttgttggccgtatttatgattggtggatcgcggcttatggtgatgaaggttactctatagatgcagatccaggtgtcgcttcagtatcaaatatttacgcgtattacaaaaaattcggtattcctacgcaaattatggcagcatcttttcgtacaaaagagcaggtactagcattagctggttgcgatcttttaacgatatctccaaagctgctggatgagctaaagaaatctcaacacccagtaaaaaaagaattagatcctgcagaagctaaaaagttagatgtgcagccaatagaactcacagaaagcttttttcgctttttaatgaatgaggatgctatggctacagaaaaacttgctgaaggaattcggatatttgcaggagatactcaaattcttgagactgcaattacagagtttataaagcaaattgctgcagaaggtgcgtaattgcttactaaattaagccggtttggggataccaccttaaagcgaaatgaaaaataagatggactataaatcgcaactagtattttcttgcccttgttgttgcaaaggcaatgtttgtttctcagtttttaacttagacgttattttaacatgtaacgtttgctcatctacttatacattcgattctgtcatacgtaatgagattcgtcagtttgtagcactatgtaaaaggatacatgatgctaattctatacttggaaatgctactgtgtcggtatcggtagaagacaaccaaatggatattccctttcaattgctgttttctcgtttccctgtagtattaaatctctctttagatggaaagaaaatagctattcgtttcctctttgatgctttaaatacaagtatcttacaccaagaaagcgatcttatttcttaatcctaagtttatttgttttcgttttgcagagcttccaaagctttttcaaggattgcatctcctgaagtagcctctttaccaccgcgaatttggaaagaagagactacttttaaaaaggtaaatgaaagttctgcatagtcatccaaagttgcagtgcttgtaaaaatataagcagtatggtcaatgactgttgtcgcttgtaaacaaaatacacgtccccatgaagagtttttctctgttttgataatagtaaactctccgctaggagattgaatttgggtaaatattccagattctaaagtcatctcattggctttatgataggctaagatttcctcaatatactcttttgaagatttggaagtgatttcctgagcaatgttgatggtaggagtgagatttcctttccccttgcctataaggagaacatctaatttttctgggagctgtgttttatcgtcaatacactgccaaagagagggtgtctgtatgctatagtttttccctgaatagcgaacccattggacgggggagagcgagggttttttctcaaattttcctatttttttccgcgcagctgctcttgttttatagcgagaaacactcgcattcgttgctgccgaagatcgtatcctagaggtccttcttgcttttgcttgctttgagtgagatgcagagacttgagttcttggctgagcagagaaagcagggaattgagctacaatcaaaataaaaagaataaaaaatttcatagaaaattatgtagttagttgtacattaagatagattcaaagcacatagcatagctctctaccttatacaagattgtatcgttttcagaaaaatattcccaatagggaatctttggatctagaagaaggcctactttcaaacaaacatagaaaggcaattcttcttttttgaattctatgtttataggaattttttcttagagagttagaggagagcatgggatttatcttgaagatatcaaagcaattttcttctagaacatctctgcaacccgtttcttatttgtggatcagttgaattaaatgctagaatgacataaactgttagattagtggaatcataataacatcttttttaaagaaaattcttttctaaaagaataagcggtaaaatattatggcgaatcttaatgccgatggtaagcttaagcaaatctgcgatgctttgcgtttagacactctaaagcctgcagaagacgaggctgcggcgttattgcataatgctaaagaacaagcgaaaagaattattcaagaagctcaagaagaagccagaaaaatcttagagacggcagaagagagagctcatcaaaagataaaacaaggcgaagttgctctaagccaagcagggaagcgcgctttggaagccttaaaacaggctgtagaaaacaaaatatttagagagtctttagtagagtggctggagcatgtaaccaccgatcctgaggtttctacaaagttaattcaagctttagtgcaggctttggaagctcaaggggtttcaggaaatctgaccgcctatataggaaaacatgtgagtcctagagctgttaatgagctcctaggaaaggctgtaacaacaaaactacgaaagaaaagtgtagttgttggaagttttgttggtggtgttcaattaaaagttgaagaaaagaactgggttctggatcttagttcctcagctcttcttgagattttcacacgttatttgcagaaagattttcgtgaaatgatttttcaaggatcttgactttaataaagtcatgaaaagatcttctcaatatttaaagttgtcgtcatgactcaatattattttttatcttcatttttacctactcagctaccagaatccgtacctctattttctatttcggacttagacgatctactttatttaaacctatcagaaaacgatctttgcaattacggacttcttaaacgtttttttgatttcgaaaatttcgctttcttttgggctggtaaaccgattcccttctcttttggggaggtgactcaggaaaatgtagaaagaatgctttcctctcagcagtggtctgatgacaatgattttgaagatttctttaaggattttttaatgaatcataagtcttctcaagatcgtttgaatcacttttcagatttatttagagagtttctttcctatcatcaaacgaattcttcaaagtttcttcaagattatttcagatttcaacaacaacttcgtgttgtactcgcgggattccgtgcaagagtcttgaatatggatgtttcctatgttttgcgcgacgaagatagttccgatccagttgtgctcgaggtgctcatgcagaaagattctcctaattatgagcttcctgaagagttttcggatttacagggcgttttggatgactacggcctcttgcctcatacactgaatcgtgcgcttgccctataccaatttcataaactcgagggattttgttctgactcctactttgatgggaatgtcattttagcaagatgtgctacatatatgtttgctattcgtaacagcttagcaagtgttgaaaaaggaagagaaattattaatcatatagaaaaggcaatcaaatggtaacagtttcagaacaaactgctcagggacatgttatagaagcttatggaaacttgttacgtgtacgctttgacggatatgttagacaaggtgaagttgcatatgtcaacgtagataatacctggttaaaagcagaagtgattgaagttgctgatcaagaagtcaaggttcaggtatttgaagatacacaaggcgcgtgtcgaggagctcttgttacgttttcaggacatcttttagaagccgagttagggcctggcttgcttcagggcattttcgatggacttcaaaatcgtcttgaggtgctagctgaagatagttctttcttgcagagaggcaagcatgttaatgctatttctgatcataatttatggaattatactcccgtagcttctgttggggatactttaagacgaggagatcttctaggaacagtacctgaaggacgatttactcataagattatggttcctttttcttgctttcaagaggttaccctgacttgggtaatttctgaaggaacctataatgctcatactgtggtcgcaaaagctcgagatgctcagggtaaagaatgtgcctttactatggtgcaaagatggccgatcaaacaagcttttattgaaggagagaagatccctgcgcataagattatggatgtgggtttgcgaatcttagatacgcaaattccagtattgaaggggggaactttctgtaccccaggaccttttggtgcagggaaaacagtcttacaacaccatctttctaagtacgctgctgtagatattgtgattttgtgtgcgtgcggagagcgtgctggtgaagttgttgaggtattacaagagttccctcatcttatcgacccccataccggaaagtctttaatgcacagaacatgtattatttgtaacacatcatccatgcctgtggctgcccgagagtcttcgatctatttaggagtgacgattgcagaatactatcgccagatgggactagatattctgcttttagctgattctacatcccgatgggcacaagcccttagagagatttcgggacgtcttgaagaaatccctggagaggaagcatttcctgcatacctgtcttctagaatagctgctttttatgagcgaggaggagctatcaccacgaaagatggttctgaaggatctttaactatatgtggtgcggtgtctcctgcaggaggaaactttgaagaaccagtcactcaatctacattagctgtagtcggagcgttctgtggtctttcaaaagcacgagctgacgcacgtaggtatccttcaatagaccctttgatttcttggtcaaaatatttgaaccaggtaggacaaattttagaagagaaggtttcaggctggggtggtgctgtgaaaaaagcagcacagtttctagagaaaggttcagaaatcggcaagcgtatggaagttgtcggtgaagaaggggtttctatggaagacatggaaatctacttaaaggcagaactttatgatttttgttatctccagcagaacgcattcgatcctgtggactgttattgtccttttgagagacagatagagttattttcattaatcagtcgtatttttgatgctaaatttgtttttgatagtcctgatgatgcaagaagctttttccttgagctgcagagcaagattaagacattaaatggcctgaaatttctttcagaggaatatcatgagagtaaagaggtcatagttagactgttggaaaaaacaatggtacaaatggcgtaaggatatgcaaacaatctacacaaaaataactgatattaaaggcaatttaatcactgtagaagcagagggagctcgtttaggggagcttgctacaatcacaagatccgacggaagatcttcgtatgcttcggtattgcgttttgaccttaagaaagtaactctccaggtttttggtggcacatcgggcttatccactggagatcatgtcacgttcttagggagacccatggaggtcacatttgggagctcattattaggcagacgattgaatggtatagggaaacccattgataatgagggggagtgttttggagaacctatagagattgctactccaacatttaaccctgtctgtcgtattgttcctaggagtatggtacggacaaatattcctatgattgatgttttcaactgtttagtgaaatctcagaaaattcctattttttcttcttctggagaacatcataatgctttgttaatgcggattgctgcacagacagacgcggatatagttgtgattggtgggatggggcttacattcgtagattacagcttttttgttgaagagtctaagaagctaggatttgcagataagtgtgtgatgtttattcataaagctgtagatgctcctgtagaatgtgttttggttcctgatatggccctagcttgtgctgaaaaatttgctgtagaagagaaaaagaacgtcttggttttgcttacagacatgacagcgtttgctgatgctcttaaggaaatttctatcactatggatcaaattcctgccaatcgtgggtaccccggttccctatattctgatctagctttacgctatgaaaaagctgtagaaattgccgatggggggtcgatcaccttaattactgtaactacgatgcctagtgacgacattacacatcctgttcctgataacacaggatacattacagagggacaattctacttgaggaataatcgtatagatccgtttggttctctttcaagattgaagcagctggtcattggtaaggtgactcgagaggatcatggagatcttgcgaatgctttaattcgtctttatgcggattcccgtaaagctacagaaagaatggctatgggattcaagttatcgaattgggataagaaattacttgcgttttccgagctttttgaaactcgtttgatgagtttagaggtaaatattcctttagaagaagctttagatattggttggaaaattctagctcaaagtttcacttctgaagaagtgggaattaaagcccagttaataaataagtattggccaaaagcatgtctgtccaagtaaagctaacaaagaactcctttcgactagaaaaacaaaaactagcacgattacaaacgtaccttccgacattaaaacttaagaaagctttattgcaggctgaggtacaaaacgctgttaaagatgctgcagagtgtgacaaggactatgtacaggcttatgagcggatttatgcttttgcggaattgtttagtattcctctctgtacagattgtgtagagaagagttttgagattcagagtatagataacgactttgaaaacatagctggtgttgaggtccctatagtccgtgaggtaacactatttccagcttcgtattctcttttagggaccccgatatggttagatacgatgctctcagcatcaaaagaacttgtggtcaaaaaagtcatggccgaagtctcgaaagaacgtctaaagatcttagaagaagaattacgagccgtttcaattcgagtcaatttatttgagaagaagctcattcctgaaactacgaagatactcaagaagattgcggttttcttaagtgatcgtagcatcaccgatgtaggtcaagttaaaatggcaaaaaagaagatagaactccggaaagcaaggggggatgagtgcgtttaaatatacataagtatctctttataggacgcaataaggcggattttttttctgcaagtagagagcttggtgttgtagagtttatttctaaaaagtgtttcattaccacagaacagggccatcgttttgtagaatgcttaaaagtttttgatcatttagaagccgaatactccttagaagctttagagtttgttaaagatgagagtgtttcagtcgaagatattgtctccgaggtccttactttaaataaggaaatcaagggacttttagaaactgtaaaggcattaaggaaagagattgttagagtcaagcccctaggggcattttcttcttcagagattgcagagctgtctagaaagacaggaatatctctacgatttttctataggacgcataaagataatgaggatttagaggaggactctcctaacgttttttatctttctacagcgtataattttgattattatctagttcttggagttgtggatcttcctagagatcgctacacagagattgaagctccacgttctgtaaatgagttgcaagtagaccttgcaaatcttcagcgcgagattagaaacagatccgaccgtctttgtgatctctatgcctatcgtagagaagtcctgcgagggctttgtaattatgacaatgaacaaaggcttcatcaagcaaaagagtgttgcgaggacttgttcgatgggaaagtctttgctgttgcgggttgggtcatcgtcgatagaatcaaagaattacaaagtctttgcaatcgttatcaaatttatatggaaagggttcctgttgatcctgatgagacgatccctacctaccttgagaataaaggtgtaggtatgatgggagaggatcttgtacagatttatgatactccagcatattccgataaagatccttccacttgggtattttttgcttttgtgctcttcttctctatgattgtcaatgatgctggctacggcctgctatttctaatgtcttcgcttctattctcttggaaattccgtcgtaagatgaagttctctaaacatctctcacgcatgctgaagatgaccgctattttaggtcttggttgtatatgttggggaacgacaacaacttcattttttggaatgagttttagtaaaacgagtgtgtttagagaatactctatgacgcatgtcttggctttgaaaaaggccgaatactacctgcaaatgcgtcctaaagcctataaggaactcacgaatgagtacccctcgttaaaagcgattcgtgatcccaaggccttcttgctagcaactgaaataggaagtgcaggtatagaatctcgttatgtagtctacgataagtttatcgataatatccttatggaattagcgctgtttattggagtcgtacacctttccttaggtatgttgcgctatcttcgttatcgttattctggcattgggtggattctctttatggttagcgcctatctttatgtgcctatttatcttggtactgtatctttgattcattatcttttccatgttccctatgaattaggaggacaaataggatattatggcatgtttggtggaattgggcttgctgttgtactggcaatgatacagaggagttggcgtggagttgaggaaatcatttctgtgatccaagtgttctctgatgttctctcgtatctccgtatatatgctttaggacttgctggtgctatgatgggagccacgtttaatcaaatgggagcaagattgcctatgcttcttggttctatagttattcttcttggtcactccgtgaatatcattctttctattatgggaggagtgattcatggacttaggttaaattttatagagtggtaccactacagttttgatgggggaggtcgtcccttacgtcctctgagaaagattgtctgtagcgaagatgctgaggcttcggggattcacttagataataattcaatagtttgataaacttcccttgcctttaagagaggaacatgaaagaaatcttgtcaagttcgtaattatttaaaggtatttgaagggagcacatgaggtaagtatgattgatatgtctgttgttgggcctgctttggttttaggcttagctatgattggaagtgctataggatgtggcatggctggagtcgcttcacatgcagtaatgtctcggatagatgaaggacatgggaagttgataggaatgtcagcgatgccctcatctcagtctatctatgggtttattttgatgttgctgatgcaagcagcaataaaaaatggaaccctatcgccagtaggagggatcgctataggtttatctgtgggagccgcccttttagtatcttccgtgatgcaaggcaagtgttgtgtcagcggaattcaagcttatgctcgatcttcgtcaatatatgggaagtgttatgcagcgattgggattgtcgaatctttttcattgtttgctgttgtttttgcgctactactactctaaacttgtatttgggcttacagttctgttagccgcaataagtgtgatttgcttattgggttgttcagaaccttcattatcttcttttacagaatacgtaggtccagagtatagtgcagcagcccaactcagtatcgagcagagttgtcatgatgaggtgtatggacagcaggttgtagtgacctggagtcttccctcacgtatgaggaaatgccttcccgtgactttgtatctctgggtatattatggtaatggcaaggtagagaaattgacctatgaggtcaatcaaagtgcggggtatcgagtgtattgcctcaagggactagaatacaaagaactccagggcattatctcctatcgcgttgcgttatgtagcgggaatcaagagattgtgagtaggcgtcaccatctttggatggaggttatctctctggattctccttaataaaaaatatcaaatcataaacatgccctatttttagaaaaagcagcataaagataataaaatagaactatgctacttgctctaagtttacagggtatttcttagtagagatcacaaatttggattaagaattatgacaacagaagattttccaaaagcatataactttcaggatacagaacccgagttgtatgtgttttgggaaaagaatgggatgtttaaggctgaagcttcgagtgataagcctccatattctgtaatcatgccgcccccaaatgttactggggttttgcatatgggccatgctttggtcaatacccttcaagatgttcttgttcgttacaaacgcatgtcaggatttgaagtttgttggattccaggaactgaccatgcaggaattgctacccaggctgtagtggaaaggcatctccaagcttctgaaggcaagcgtcgtacggactatagccgagaagactttttgaagcatatttgggcatggaaagaaaagagcgaaaaagtcgttctctcccaactgcgacagctggggtgttcctgtgattgggataggaaacgctttactatggagccgcttgcgaatcgtgcggtcaaaaaagctttcaaaaccctatttgaaaatgggtatatttatcgtgggtactaccttgtaaactgggatcctgttctccaaaccgccctggcggatgatgaggtggaatacgaagagaaagatggatggctctattatattcgctatcgtatggtaggttctcaagagtctattgttgtagcaacaacaagacccgaaacttcattaggagacactgggatcgcagtgtctcctaacgacgagcgctatgcatcatggattggtgcgagcgttgaagtgccttttgtaaatcgtcagattcctatcattggagatgcttctgtagatcctactttcggaacaggagctgtaaaagtgactcctgctcatgataaggacgattatcttatggggaccaaccatcatcttcctatgattaacattctcaccccctcaggaggaatcaatgagaatggtggaccttttgctgggatggctaaagagaaagcacgcgaggagatcctcattgcactagaagaacaggggttatttgtaaggaaagagccttataagcttcgtgtcggtgtttcttatcgatctggagctgtaattgagccttatctttctaaacagtggtttgtctctgtgtcagagttccgtggagctttgcgagagtttgtagaaagtcaagatattaagattttccctaaagactttgtcaaaaattacttgtcctgggtcaaccaccttagagattggtgtattagtaggcagctgtggtggggacatcgtattcctgtttggtatcataaaaatgatgacgaacgggtcctttgttatgatggagagggcattcctgaagaagtcgctcaagatcctgattcttggtaccaggatcccgatgttctagatacctggttctcttcaggcttatggccactgacctgcttggggtggcctgatgaaaattctccagatttgaagaaattttaccccaccgctctattagttacagggcacgacatcttgtttttctgggtaactcggatggtgttactatgttcttcaatgtcaggggaaaagcctttttcagaagttttccttcatggattgatatttgggaagtcttataagcgttataacgactttggtgaatggtcctatatttctgggaaagagaagctagcttatgatatgggagaagcgcttcccgatggtgttgttgccaaatgggaaaagctctctaaatccaaagggaacgttatcgatcctttagagatgatcgctacttatggtaccgatgcggtacgcttgactttgtgttcttgtgcaaatcgcggagagcagatagatcttgattacaggctatttgaagaatacaagcactttgcaaataaggtttggaacggagctaggtttatctttggtcatatctcagatcttcagggcaaggatttgcttgcaggtattgatgaagactctttagggcttgaagatttttatattttagatggttttaaccaactgattcatcagcttgaggaggcttatgctacctatgcttttgataaagtggcaactttagcttatgaatttttccgtaatgatctctgttccacgtatattgagattattaaacccacactctttggtaagcagggaaacgaggcttcgcaatctacgaagcggaccttacttgctgttcttcttattaatgtattaggagttcttcatcctgtagctcctttcattacagaatctttatttttaagaattcaggataccttaggagcccttcctgaaggagatggggatgcatttacaggtcatgctttacgtatgctacgttctcgtgcttgtatggaagctccctatccaaaagcttttgatgttaagataccccaagatcttagagaatcttttactttagctcaaaggctcgtttatactattaggaatatccgtggggagatgcaactggatccgcgtttacatctgaaagcttttgttgtttgttctgatactaccgagattcagagctgtatccccatacttcaggcattaggagggttagaatctatacagctcctagataaagagcctgaaaagggcctctatagctttggtgttgttgatactatacgcctggggatttttgtccctgaagagcatcttcttaaagagaaagggcgtttagaaaaagaaagagttaggttagaacgagctgtggagaacttagagcgcttattaggagatgagagtttttgccaaaaggcaaacccgaatcttgtagttgcgaagcaagaagctttaaagaataatcgtatagaattacaaggcattcttgataagcttgcatcgtttgcttagacagagaggaccaacgatctttggagcgctatgatattgttagaattattggaaagggaggcatgggtgaagtctatcttgcctacgatcctgtatgttctcgtaaagtagctcttaaaaaaattcgtgaagatcttgcagaaaatcctcttttgaaaaggaggtttttacgagaggcaagaattgccgctgaccttattcatcctggtgttgttcctgtctatactatttacagcgagaaagatcctgtatactacacgatgccctacatagagggatatacactaaaaaccttactgaagagtgtatggcaaaaggaatccctgtctaaggaattagcagagaaaacttctgtaggggcatttctttctatctttcataagatctgctgcactatagaatatgtccattctcggggcattcttcatcgcgaccttaaacccgataacatcttattaggtctttttagtgaggctgtaatcttagattggggagcagcagttgcctgtggagaagaagaggatcttcttgatatagatgtcagcaaagaggaggtgctctcttcaagaatgacaattccaggaagaatagtagggactccagattatatggctcctgagaggctcctgggccatccagcttctaaaagtacagacatttatgctttaggagtggttctttatcagatgctcactctctcttttccttatagaagaaaaaaaggaaagaaaatagttcttgacggtcagagaattccaagtcctcaagaggtagctccttatcgagaaatccctccgtttctttccgctgtagtgatgagaatgttggctgtagatcctcaagagcgctattcttcggtaacagagcttaaggaagatatcgagagtcatctgaaagggagtcctaaatggactttaaccacagccctgccacctaaaaaatcttctagttggaagctaaacgaacctattttactttctaagtattttccaatgttggaggtctctccagcgtcatggtacagtttagcaatctctaatattgagagtttttctgagatgcgcttggagtatactctttctaaaaaaggcttgaacgaaggctttggtattttacttcccacgtcagaaaatgctttagggggagatttttaccaggggtatggcttttggctgcatattaaggagagaaccttatccgtgtctctggtgaaaaatagcctagaaatccagaggtgctctcaagatttggaatctgataaagagaccttcttgatagctttagagcagcataatcatagtttatctttgtttgtcgatggtacgacttggcttatccatatgaattatctgccaagtcgtagtgggcgagtcgctatcatagttcgcgatatggaagatatcctggaagatataggcatttttgaaagtagtggctctttgagggtcagttgtcttgctgttcctgacgcttttcttgctgagaagttatatgatcgcgctttagtgctttaccgaaggatcgcagaatctttcccaggacgtaaagaaggttatgaagcaaggttcagagcaggaattacagttttagagaaggcctctacagataataatgaacaggaatttgctctagccattgaagaattctcaaaattacatgacggggttgctgctcccttagaataccttggtaaggctttagtatatcagagactccaagagtataatgaagaaattaagagtttgctattagcattgaaacgttattcgcagcatcctgaaatctttaggcttaaagaccatgtggtttaccgactccatgagagcttttataaacgggatcgccttgctctggtgttcatgattttagtattggaaatagctccccaggcaatcactccagggcaggaagaaaaaatcctggtttggttaaaggacaaatctcgggctaccttattttgcctcctggatcccacggtcttagagctgcgctcttctaaaatggaattatttttaagttattggtctgggtttattccccatctcaatagtctatttcatagagcttgggatcaaagcgatgtgcgagctttgatcgagattttctatgttgcttgtgatcttcataaatggcagtttctctcttcttgtatcgacatatttaaagagtctcttgaggatcagaaagccacagaagagattgttgagttctctttcgaggatttaggggcatttctttttgctattcagagcatctttaacaaggaagatgcagagaagatctttgtttctaatgatcaattatcgccaatccttcttgtttatatattcgatctttttgcaaatcgtgctcttctggaatctcaaggagaggctatttttcaggctttggatctcatccgaagtaaagttcctgaaaatttttatcatgattacttgcggaatcatgaaatccgagcgcatctttggtgccgcaatgagaaggctctaagcacgatttttgaaaactatacagagaaacagctaaaggatgagcaacatgaactgttcgttctctatggatgttaccttgctcttatacaaggtgctgaggcggcaaagcagcattttgatgtatgtcgtgaagatcgcattttccctgcttcattattagctagaaattacaatcgtttaggtcttcccaaagatgctcttagctatcaagagcggcgtttgttattgcgacaaaagtttctctatttccattgtcttggtaaccacgacgagcgtgacttatgccagactatgtatcacctcttaaccgaagaatttcagctttaaatgatttgtgtatggtctcaggatcttagattctaagttcttaagaatcgagttcttcattgcagatatactttttcagcaacgagtccttacttgcatagatatctttgggagatcctgaaaaaagaagctttcctccttgtttcccagatcccgggcctatctctatgaggtagtccgcagattttaacaacttcacatcgtgatctatgtagattaccgagtggccgctatttatgagggagcgaagtttttctggaagatgttgttttttgattggatctagagaagaaaagagctcatcaatgagaaatagggtgggagtctctggagtttgatagagaaaataagcagttttcagtgctgttttttcacttacagataaggaagagagtttttggccgataggaagatagccgagtcctatgtcaagaagtgcttttagaggtttttgtatctttttaataaagggaaatcggagggctacagtttcaatcggagtatgcaaaagttctccgaaatgcttgccttcataaaggacttcctgagcaagaggttggatacgaaatcctgagcaggtagggcagggacgcttttctaaagcgtaaaaagcccgatctatccattggtacccaagtccttggcaatccgagcattgtccttgttttgtatttgtactgaacatcgtagatgaaatattcagggctttggcttgtgttagcgaagcataaaaagctctcaaggaaggagcaatatcgaaataggtgctgatatcagagcgttgcgatgaagctattggatgagagtcgatcactacaaggtcggaaaatgttgtagttccttttgctatcaggagctcagcttgttttttaaatccttctaaaagtagagaggttttcccagatcctgaaactcctccaatggcaaccaaagcatggagaggagccgatactttcaaattctgaatatggtgtatcgatagatttacctttaatgtacgatcggatcctcgggtatggtttgccttacttatagaaagtggagccttgggacaaacctcagtttggggaacgttagcgtgtaggtctacagatgggcaaacctcagtatcagaatccatgagaaatcctccttgaggtccagatcctggacccaagaagatcgcgtgatcggcatgggggattaaagaacaggaccgatcggtagcaattactgtgttgttatttgctacgagctctttaagtagctgaactatggtaggaagatcctgggggtgcagtccagaaagaggctcttcgaataagtagacgatgttggtaagatttatagagatctttttggcaaggtgtaaacggtagttctcaccatcactgagagtgtcttgcctttgcccaagggtaatatagctcaggcctactttactaatgaaggtaaggcgattcatcaaatcttggattatgcttcttgtatcatcggttcctatagtgtttaggaaagattctaagaatgtggcatcttcctgataaatatccaaaagcgaggtattgttgattcgcacatagttggcataatcgtttagtcctgagcctttgcaggcaggacaggaggtaagagcaagcagaggttttatcaggggagagtcagattcagtatctagctgctccataagtagtgcgttcattcctggaaactctgaggaacctcggcaaaaatttaggaactctttcgtagttagcaactttagtggttgagaggcattctcatctttaagcagcttttgtacaggcttcatatagctctttggaaagaataaactaaaaaactctaaaggagtgtagtgagcaattttttctttatgctcttctagggagatttttaggatttcgccacgacctccacatgtaaggcaacgaccctcgggatggtcagaagaaagtagttgatgtgtaatctcgggatagagtctccctttcttatctttccaccctaaggaatacgagagttttcgttgctttttctgagagatatagatccagatttctgaggatagagaaaaagctaccgagattgcggataataaagaggaactatttttcggggatacttttgtatgttgtatgactatagcaggttctatgagatttagaggcagcctctcatctaaatcatagaggttcccctcagaatataactttatgaatccctctttttgtttttcttgaaggaagatttccagatcagaaccaagaggaatcggagaggttatagtgacgtaatcgtctttatagcttttgagtaggctatcgatgatggtctgaggtgtagttttagagagtttttcttctgtaaggggagaaaaaggttctcctaagatggcaaagagcttttccagaccattgcttaatccgagagccgaggctattgtatggtacgagcgattggaggagctacattttcttaccgaaatgactggagagagtccttttacctctcctacagagggtagaggagtctccttaagcagaccctgtctaatgtagggagggaagagctcggcataagcgatatttcctgatgcatagagtatatcaaagactaaagaatgtttccctgaggctccaggacccgcaattgctattagggagtttctcggaagagcaagatctatgtgtttgagattattttgataggcatccttgataaggatatcacaagatttaggagaggatggcggttcagattttactaccggtatgtctagagaaccttcaatatagggggccaacgcttttgctgttggagtatttagttggataagatccttaggggtgcaggatgccaggaggtatcctccgagatctcctccttcaggacctaattccaaaacataatcacaaactttgacaacgtgcatgttatgttcgataacaaggactgtgtgccctagatatgtgagggatagaaggacctcgatcagtgcttggatatcatgagtatgaaggcctgtcgtaggttcatctaggacatagagtgtttgcttaggagaagcaaagagaagctcgtgagcgagttttagcctttgaatttcccctccggataatgtggaaagaggtcttcctaagggcaggtaatctaggcgtagggaacatagagcatggattttttcatgaattttaggatgtgaaatgaaaaatttttctgcttcgtacgctgtcatatctaaaatatcagcgatgttcttcccttcatagaggatttccaatacttctgagtgataacgcttcccttggcattcagaacaggggatgggtgtatcatcatcggagatggtcatcgttcctaacccctgacactgaatacaagctccttgaggttggttgaagctaaaatgagcttttgtcagtccttgacgtaggctgcgaggttgagaggcgaagagttcccggatatcatcaaaggctttaatataggtcaaaggtatcgaacgctgtgagcgtcctggaagatctcgggtaatgtgaatcaagcggcctatgcatccccactcaaaatgcagatttttagggttctcttgtttcaagaagctttctatagcaggcactaacgtattattaattaaagaggatttccccgatccagagactcctgtaactccgattagccgagctaacggcagacgaatagaaagatttttaaggttgtggatcgttgcctctgttagcaagagccaagatgtgggagcttcccgggattctggaatgggaatggtaagctcttgacgcaagtattttgctgtcagagatgaggagttcatgaggaagtcctcaggctttccattaaagaggacctcgcctccgaaaattccggctccagggccgatgtcaataatcctatccgcaagagaaatcatccgttcttcatgctcaacaagaatcaccgtattgccttgatctcgtagctttttaatgacaccgatgagcttttcagtgtcttgtggatgcaagcctatggagggctcatctaggatataggtaattccaaaaagttctcctcctaggtgttttgctattgctgtacgttcttgttctcctccagaaagggtagctaatgcgcgatttggagtgaggtagcctagccctaagtcaataagaaaagagagcctttgctttagtccctgcaggatttcttgaatagagagagaaggagattttaccttagaaaaaaatacgtgccagttatttagagacatctgttggaattcagtgaatgtttttccttcccaagtagctacggaagcgtagtctcctaggcctgtacctttacatagggaacaggaatgtgctgacatgcctttggagagataacgtgagggcttcgtggtataacgaactttatctcctatatcgttaagtacacctctccatactttataggtgagattcttttttcctaaagtttgatcgaagagtcgtacaggaagaaccaagttattttttcccctaagaaaaatattttggatttctggggaaagatctttccatggagtttctagattgaaatttaaggcatcagcaagagcttggtatatagtatgatagagataggaagaacaatttccagcaaagctacagcaattctctttaatcgaaagattttcatcgataagaaggggattatctatggaaataaagatcccggatccttgacaaagagagcaacggctctccagggcatgaggagaaaataattgttgagttagaggggtataggtgacgtcatcgatctgttgctttgtggagaatgtcatgagctcttcgtcactaagaactgagcaatgaccctctccgaattccaaagctgtgaataggctaactttgagccttgcaatattattttcacttttgattagagtatcaataacaatatcaacagagcagtcttcaggaatccctgaagttaggaaggagtaaatggggtggatcgtgccgttacaacgtacttttgtaaatccctgttgtgcatactcatggattgcagcaatatctttacgtagcagaggagctaaaatagagatctgtacaccttcagagagctccataatggtactaagaactttctccttgctgtagagatctaagacttctttagtcttaggatctcgagcctgtccttctagcgtgaagagaagagcaaggtgcgaaaaaagttcagtagtgctcccgacagtcgcatgactatagtgtgaaaagtggttctgttttattgctattgttggtgagagaccatgaatttcttctactttaggattgggcagcgtcgttatcgtagtagcgaagaatgtcggaagtgttgaaatatagcgttttcttccagcagcatatagggtatcaaaggctatcgaggattttcctgatcccgaaactcctgtgagtagaacgatttcctcggagttaaaatggatagaaacgttttttagatttctaactttgatcccagaaacatatacaggaagtgatttcataaagaattctcgtaatatacttagaaaggtctcttacctaaccttgagaaaagagtcatatccgcactgatatcttgggatttcaagtacaaattaaaccgcaatattgtatattcctgcaagtatcctccctctcaagagtttgagttaataaagagaattttttaatattttttcaaaaaagaatataaaatatttcattataccatgagtttttcattgaatagacaataggacagtatgatcacacgcactaaaattatttgcactatagggccagcaacgaatagtccagagatgttagcaaaacttctagatgctgggatgaacgtagcaagattaaatttcagtcatgggagtcacgaaactcatggacaggctattggatttctcaaggagttaagggagcagaagcgggttcctttagcaattatgctagatactaaggggcctgaaattcgtttagggaatattcctcagccaatttcggtttctcagggacaaaagcttcgtctggtaagtagtgatatcgatgggagtgctgaagggggagtgtctctctatcctaaggggatatttccctttgttcctgagggtgctgatgttttaatagatgatggctacattcatgctgttgttgtctcttcagaggctgattctttagaattagagtttatgaacagtggccttctcaagtctcataaatctttgagtatccgaggtgttgatgttgctcttccctttatgacagagaaagatattgcggatcttaagtttggggtagagcagaatatggatgtggttgctgcatcttttgtgcgctacggtgaagatattgaaactatgcgcaagtgtttagcagacttaggcaatcctaagatgcccatcattgcaaaaatagaaaatcgtttaggggtagaaaatttctctaagattgccaagcttgcggatggaattatgattgctagaggagatttaggaatcgagctttctgtcgttgaagtcccaaatttgcaaaagatgatggctaaggtttctagagaaacaggtcacttctgtgtgactgcaacgcagatgctagaatctatgattcgcaatgtcttacctacacgagctgaagtctctgatattgccaatgcaatttatgatggttcttcagcagtgatgttgtcaggggaaactgcatctggagcccatcccgtggctgccgtgaaaatcatgcgttctgtgattttagaaacagaaaagaatctctcccatgattcattcttaaaattagacgatagcaatagcgctcttcaggtgtccccctatctctcagccattggattggcaggcattcagattgcagaaagggcagacgccaaagctcttattgtttatacagaatcaggaagttctccgatgtttctctctaaatatcgtccgaaattccctatcattgccgtgactccaagcacttctgtttactatcgcctagctttggaatggggggtctatcctatgcttacccaggaaagtgatcgcgctgtatggagacatcaggcctgtatttatggcatagaacagggcattctctctaattatgatcggattcttgtgcttagcagaggagcctgtatggaagaaacaaataatcttaccctgacaatagtgaatgatattttgactgggtcggaatttcctgaaacctagaatttttgctttaaaatccaggacttcgcaaatttttcgagaatatacagatgttttcgtaaatatgaattagggcttttactccactgtaagtcggggccccttcgacttcaccttgaagttttttctctctttatctttaagatttttagaatagaagatcctcaaagagttttttagaggagcttgggggtggtctagagatttttctaggaatcttttagagtacacagcacaagaacctgtttttctaaaatgcttgtataaatgctgtagattgttagtgagatcaaaaatagcaggatagcaattcggtagagctagaatgtcttgatcatttcggagttggatcaaggagtactctgggaattgttcttgaagttcttcaagatgatccgcatttcctagtgctagatgaagagtggttcctgaaaagcattctgctagagctttcagaaaagaaaagtgtgaggagacttgatctacaaaaactagaatatggctatagcggtacttcttttttattacgttagagatctttctcttccaccttttatgaatccacatccattgttcaggctgactggcgatccctttttctaaaaatcccatcatctgatccataaggatagccacggattctttcatagggaggcttttattagcatacagcttggcactcggaatcacttcgaagcctttagcttggcgagaaacattaacagcaatcacaggaaaacctgttttataagctaatagtgctggagatgtcgttgtgaatgctggagagccaaagagaggatacgtgtatgaagacatcaacaaggcttgatctccaacaatccccacgagtttcccttgattcagagcttctatgccctgttggattccgttttttgggggtacaatcttacctttgaaaacttctctaagagcaaagattttcttgctgagcctttgattttttatagccttagcaaaggcgattccaggatagtttttagtgatataaagaaaaggaagttcccagtttgcctggtggccacaaaataaaataaggccctgcttctcttgtagattcttaaaagtttcctctaaatcttcattggaaatgacctcttcagaagaaaaacctttggggtttcgtgaggatgtcacgattgtaatgagtttgtctatatttccgacaagttgctcgattgcgagtaattctaagagtgtaattataagatgctgcaaagattgacgagctattttataacgctcatcaaatgttttttctggaaacgctaatgctaagtttgtgagggctgtttttcgataatcgctgatgatataaaaggctagaaatccaaaaccttttcctaatcctgttaaaaaagatcttggggtatgcctgcataaagcaataataccagagactaggtaatacagaggggcttctaggattgttctcttgatctgatggaattttttgcccacaagctaatttgactttcgcaaatcactttaaataatactattgtgcttcttactatctcaagatttctcgttttgcagcgaagcacgctccagaaaggaacatgcttaacagtatcgtaactacgagaactaggacagcagcaacattactcattccgaaagtcatcccagaagctccaagcactccagtacaaatcaaaatgatcagtataaaagaaacaatagcagtaagagctaaaagtcctgcagacactgtcgctacatttgctttggattctgagctatcagaacaacaacaaactgtgttgattgcagcttcaaagccccggcccaagcaatctattaagcacataaagtttcccctaactaaattttagtgagtctgcactaccactcttttttatataatttagttgtttcctttgtttttgtctggatcacaactttattatttttgatttctgcaataagatttaaaggttcaccgtctgctgtaaaaagtgcaagctttcttaaatattctcggaatctatgacgaattccagcctcatcaataagggctatatcgtgtaaaattccatgttcttgggctataatagtctgaagaaaagtattttctaaagttttttcatctaaaaattctatagcccagttgatcgaagaagggtcttgtggtgagggcatcacaattgttaagaccatgttgttctttacgacatctaaaaactgtctacttacatccttaacatataaaggaatatttatttgatgaattccatgattcagaataatgggagggacaggatctaagctgtactctagaggattcatcgtttgaatgaaggttacaggaaagaatagaaagaccggtaaatttaaatttaggggaatgcattccctttttaaaaataaaaggcgaagaaaatctgcttgagggtcattgagatccatgaaggtattttcaaagggaatcaaaattttcttccattctttaggaatggggaaaataatttcgtcatgacttccctgagcaatgcgatttctttctaactcttcgaacgaaattttattcaaattaaaggttagctcaagaccttgctctttcaaagcattgatatattctttggggccactgactttttgattcaagtacttcggccagacatccaaatactcatatcctttcgggggactccctataggtttcgttatagttaataaaatgtcttcggttacatattgtgtaagtcggacaaaaatatcgttagcgtcaacgctatggatgtctttgcgtatgttgatctcatgatctacagagacaaggttatgcttatctatagtggcaatccaactttccgtatggtttgctgcactgatcactacctctaaatttgaaggacggaggtcttgaacggtatttttattcccagtgattgttaaagagacttttttattcaggaatccgcttttttgtagtccaagaacggtttggtctggatgtaggtctacgatgcgcacagggacatttgtgagtgttcgcgtgatggtaacactttgtcctacgaggatccaaatgatgatggcaaaacctaaggaaacaacttttctaggccaatgccgaataaagagttgagataaaaattttatcatcgtttccaaatccaagagaataaaggttttcttttgtgttctttaggggaaagaatactgcggagtaccgctttgaatctatctatttttactccgcgtgttagaaggccgtctctagacaaagagacacttccattttcttcagatactgtgataattagagcatcagatcgttggctagctcctagagctgcgcgatgccttgtccccatggatcgggaaagctgcgtcgtatcatgagctagtgggagaacgacgcgagcataggctagaatgtctcctcttagaatgacggcaccatcgtgcaatggagatgaaggttcgaaaatcgtctctaaaagttcttcagagaaagttgcattgattttcaccgaagaaaaacttaggtattcatcgaaagaatctttgttttctaaaacaacaagagccccgatttggcgttctgatagctgataaatactggcagctaattgctctacgaactgctcttgagtatctatgaagaattttttcccatgaaatcgtatacgagagagagccaaacgaatttctggttggaaaataataaagaccacgatggcagcgatattgactacgtggagcatcaatctacggatgatagggaggtggagtttatcggctaggacaaatagaaagagaaacgcaagcaagccaaagacaacatccatagctcgggtgccccagaaaaattttaataggtagtttaacattacccaaattaaaatgatttctagcaaaggtgttgtataataagtaatatcaaagggcatagttttactaggtccttgggtagtatactgagaaaagttgcacaaagtgctcggctattgtcctaggaaaggtaacctattatcttagcatacgaacaaaaaggttaacagcaaagtattttgtagttgcaatactttgtttcatcgttcacattacagtttctaattttatatacaattctggaagtttatggatgcgcttatcttatctagaatacaatttggattgtttataacttttcattacctttttgtgcctctgagtatgggtttgagcatgatgcttgtgatcatggaaggcctctacttggttacaaaaaagcaaatttataagcaaatgacatggttttgggttgggatttttgccctaacatttgttcttggagtcgttactggaatcatgcagatattttctttcggttctaactgggcaaatttctcagaatatacaggaaatattttcggcaccttattaggtagtgaaggtgtttttgcttttttcttggaatcaggatttttaggaattttgttatttggtcgccacaaggtctctaagaaaatgcatttcttttctacgtgcatggtagctttaggagctcatatgagtgccttttggattatttgtgcgaattcttggatgcagactccttcaggttacgagatggtgatgcataaaggaaaactcatccctgctttaacctccttctggggagtggtcttctctccaacaactatagatcgctttattcatgcagtcttaggaacttggctgtcaggagtttttcttgttataagtgtatcagcatattatttatggaaaaaacgtcatcatgagtttgctaaacaaggaatgaagatagggacgatttgtgcagttatagtcttagttttacaattgtggtctgcagatgtaacggctaggggagttgctaaaaatcagcctgcgaagttagcagcttttgaaggtatcttcaaaaccgaagaatatactcctatatgggcttttggttatgtagacatggaaaaagaacgggttatagggctgcctattccaggagcactttcttttcttgttcatagaaatataaaaaccccagtcactggtttagatcaaattcctagagatgaatggcctaatgtacaggctgtctttcagctgtatcacctgatgatcatgttgtggggggttatggtcgctttaactttgatttcctggtctgcatataagggatggcgatgggcgttaaaaccctttttcttagtcattttaactttttctgtcttattaccagaaatttgtaacgagtgtggttggtgcgctgctgaaatgggaagacaaccttgggtagttcaaggattattaaaaaccaaagatgcggtgtctcctatagtgcaggcgaatcaaattgtacaatctttggtaatatttagcttagtattcattgctcttctgactctctttattactgtactttgtaaaaaaataaagcatggtcctgaagaggaaaatgatcttacagaatttgaagtgaaatagaggtatttttatggaactttctctaacaagccttttaccacttgcgtggtatgtaattcttggagttgctgtctttgcgtattcttttggcgacggttttgatcttgggctcggagctgtttatcttaaagctaaggaggataaagaacgtcggattcttcttaattccataggacctgtatgggacggcaatgaggtctggttagtgatcattgtcggtgggttatttgcaggatttcctgcatgctatgccacacttctctcgattttctatatgcctatctggactttggtactcctttatatttttaggggatgttctttagaattccgaagtaaatcggaatcagtgtcttggaaaatattttgggatattatctttatttgttctgggactgccatcagctttttcttaggcacgattgttgggaatctgatccttggattgcctttgtctccagacacctcttatgcttctttatcctggattttatttttccgtccttatgcagccttatgtggcgctgtagttgccagtgcgtttgctattcacggttcttgcttcgcattaatgaagacttcggattctttaaatgctaggattgctcagcaatttccttatattctttcgtccttccttgtcttctatgttctcttcttaggagcaagtttaatctctattcccaagcgttttgatgctttccctacgtatccactcttgattttgctcattgctttaacgagctgctgctgtgttgctgctaagacgagcgtgtctaagaaacgttatggctacgcatttatttattctacactgaacttgttgtctctcattctgtcggcagctaccctaacgttccctaatattcttctctctactgtagatccacagtatagttatactatctacaatagcgctgttgaaactaaaacgttaaaaagccttttgattatagtgcttataggccttcctttcatcattacttatacgtgttatatttatcgtgtgtttagaggaaaaactaattttccctctatatattgagtttcatttaaagagtccgaagccttcattccatgagggtcggatttagattaaagagactgtgattgcgtatagatccaagaatgaatcgaagaacagaggatctagaaaatgaagagcttccattggaatcctttggaagctatcattatacttcgttatgaagcttctttaattccaactacataataagcaggaaaagcaaaatggttgttaggacgtgggagacattccacagtgacacgctttcctaaccattgctctaagttgatacttgtaccgtaaagaaaagcaatcgtgttttcctgagcttttagtaggtaatccccgggattgttctttactacatgaggatacacttctaatacacccgcaagcacttgttttttcttctgttcagcgcgataaaacgcttcttgtgttagtgcttcagagtggtcattgccttgctgcatactggcccagattctgaagagagaatactctaggttttctcttccttgggtaagaggagctgtttttaatgcagtttgcttacgaatatgacgtgaaagtaatgaagttgtaacttcagaagaagaaaccttaggagtggaacattgtgagcttgcaatcgaagtattttgagattctagagatttagaaagataggcatcttggatttcttctaaagctttttgtataagcccttgaattcctggaacatctttaaactcttcggattgtacaaggttgatctttttataaattgcttccagatcaatctcattgaggcttttctcaagctctatatgagcaaagtttaaagcagaattgataaggtccatggcaatctttttttgtccctcgcgttgcgtatacagctcgatgggtcctttgttagcaacaaagttttttgcaacatagaatacgcattgtgagggcaagaccacctctaaccatttcccatgtggctcttgagaagctggctgtatttgtgtgcctcgggagagtctcacaagtactggagctgatgttgagggttctaaacgaacattgacttgttcaccttcaacgacattatctaaaacaaatgagcggaacacataacctgtaattcctggaggcgcagaaattacgtagtagtctttgctttctccgataacagcaacaagatctcctttagaaaattccctaatgatggtcccatcagtatgaggtgctagacgcatccgtacgtggtttcccttaatttctccagtaaatgaagagggaagttgttctggaaaggatacggattgggaatcggcagcatagattgctggtgagttgattgcagttcctaaagctaaaagaagcatagaaatctggagcattctcatgcttttctcctacaaatatatttcgtctaaccgttggttgaaaacatcgcttacagcaaaaaggagattaacccctagaaaaagaattatattgacttcaaggaaaaagtcaatcggcttaccaaaagcttaattatgaatgcagttctactaagtatataaaacagcttttatatgttcacagttgggttcgccacaagtacagcctatggggggtcccaagtagacgctaaactgatcactaggatttaagggattcgttacaatatacaacttatccccactttgcataatgtcccaagtgcggaaagtcagatctttatcagaaaccgccagggtatcttcttcattcatgacccttccaatttggcagtgcatacaattgcaatggggttctggtctgggtaaaagcgttgcattattccctgaaagtacccgaatgacatcagccattttctctaagacgtcggtaggagcatcaggatgatctttatgttctggagtatgttgtagtattgcttcgatgggatttgttccagaaaagagaggggaaattagatttttaggtaatacttgaatgtcgtttcccttagttatctgctgcaatacattcataaggacccctacacctagtttatcatcatcacgagaatcctctttccccgattgagaagtttctaggtagagaaggtgctcttgaaaagcaatgtcaataatcgactgatctaaattaggaatagaaatgattttgccatcaataaggtggagccttagtgttccttggtctttgttttctccttcctgggattcaataaatgcaatttggctccatcttgcagagatgaatgggggaatacaaatcagttgatcattaattttgactttcatagcgatcttgggggtgaatctaatcttagcagtttgaggccattgtaaatgtatctctttttttttacaataaattagcagcatagggttttgattgctaaattttctaaaaggcacgtatcatgtaaatggattttttattatgaatatattttttgcaatagttcctgatagaaaaacgaaagtatggtagttggaccttaacaacacaatacgtcttttaatgaaaagaagggttttctttggaagttatgttagagttgttttaggcaaaaatttgtatctgataaagaataaaaggttcagtaagagaaggtgaggacgcaaatgaagaaaacaatggtcattgatacaagtgtgttcatctatgatccagaagcccttttttcttttgaaaatactcgaattatcattcctttcccagtcattgaagagctagaagccttcggaaaatttagagatgagtctgctaaaaacgcgtctcgagcattaagtaatattcgtttgcttttagagaatgcaaaaactaaagttacagatggtgtgctcttacctagtggtagtgagttgcgtatcgaggtggcgcccctttctaatgatgataggcgagggaaacttcttaccttggagttgctcaagattattgctaaacgagaacccatggtttttgtgactaagagcttgggacgcagggtgcgtgctgaagcactacaaattgagtctcgagactatgaaagtaaacgcttttcttttcgttccttataccgtggatttagagaactgcaagtttctcaggaggatattgaaaacttctataagaatggctacttagatcttcctctagacgtggtctcttcgccaaacgagtattttttcatgtccgcaggagaaaaccattttgctttgggtagatactacgtaagcgaaggaaagattatcgcattaaaggcaatggataagagtgtttggggaatcaagcctttaaatacagaacagcgatgtgccttggatttgttgcttagggatgatgtcaagttagtcaccctaatcgggcaagcaggatctggaaagaccattttggctttagcagctgctatgcataaagtttttgataaggaaacctataataaagttttggtaagccgtcccatagtccctatgggaagagatatagggtttcttccaggattaaaggaagataaactgatgcattggatgcaacctatatatgataatatggaagtgttatttagcattaaccagatggggaattcttcagaggctctccaagctcttatggatgctaaaaaattggaaatggaagctcttacctatatccgagggcgctctctacccaaagcttttattattattgatgaagctcaaaacctcactccccatgaaatcaagacaattatctcaagagctgggaaaggaacgaaaattgttcttacaggagatcctacacaaatcgatagtttgtattttgatgaaaattctaacggactcacctatctagttgggaagttccatcacttggccttatatggacacatgtttatgacacgtacagaacgttccgaacttgcagctgcggccgcaactatcctatagaaccttcgatgttataagtgacttttcttcttcggatctgtaatagcaggagttttcaagtctgtaaggacaatcaacattcttctgtctgtatttccgggttcatttccaaattcttgcatagcggcaacaagagcgcattttacagcgtgtatccatctcatgcggactttattctcttcactattaggcttttttctattttcaggaggcgcgtagatcccagaagaaattagagggatttgtaggaaggttacacctaaagtttgagctaagctgaagcagtttaggtaggcgtttttgcagcgatcaaaggctgcttgagacttgttatgatgatccactgctttaggcccaagaagttgtgctaggtagtgtggtttaccttgttttcctgtgtggttggatccatcggcatttctccacatgcctgcccgacattcaccctcattaagaggagtcccctggcgttcaggatttagaggtcgttgcgacagcccccaagaatcgacactgactgctgccgatagaacttgatttgtacccgccccatctcgactcattgttctattggctgcgtttacaatcatcatagacatactatcagtgacaagacgaggttgtgcaatatttcctgacgtcgagacaaaaatcagctttgattgatttagtgcccaggcaaagattttctggtttttttctgctggtggccatgggaacggctcctctacaggagtccaattctccaagagcatcttatgaaacagagatagaggagaaaccatagagtctggtgacggtttcttgcctaggatgggggaagcttctatacttccaggtacaatgtgatctgtaggtgtaggggagacctctggtctctgaggtatgggtggcttaggttgtgtcggtatttctttaggtgttacaggtggggggctttttttttatcttcttgtaacagatcatccaggaacggatctttgaatcctgttggagaggtaggagtagaaaatatggcgtctatttgctgccccatgtcaaggggagtaggtgttaaggggttttgaggttctcttggctctggaggacggcagcaaggacaaagataccgaacgatcaactttataatcttaatgactcctaagaccaggtaatacagagctttaatgccgaaaatttctagccaagcttcttttctaactttaggaagttcctcatagatctcaggacagggtaatgttttacacactgaagagaagttccctgtcattagaaccatagaatattgaagagaactaattccttttaaggttttgatacctataaatgtactaaatatcggaatatagcttgcaatacgttgtaaatttgtgcggtgtaagggattcactaaaggagtatttcttagtgcggttgaggtttgacccagaggcgtgtgccgatggctaattataaagacttcttcattaaaaatgctcataagaatcgccttataatgaaataaattttttcattaagaattataaaacaacttatctttcttttctatttctatgaaatctagaagggttttttaatggatatttgatttctttaaagactttaggaagacattgtctaaatttggtaaaaaagacagattctcctcgttaagaggggatgagtagcattttaaaataatttttttaaataatggaggtggagagactcgaactctcgtccttgacaaactccctgctaacctctacatgcttatcttctagaattgtttacattggactcccttagctagaagcctctatagcagccaatgactctcaaaaatctcgaacgaacttccttgagaattagagaaagtaagttccaaccagataaatgacggtattttgcaagcctctggtggagctcgcagataccgggttacctagagattatctagctaacaacttttgctaattaagcagctagtctttcctctactgagtcaaacaagctaataatttcgcattcagccttaggttcggcatttattgttttgttggctttttaggaggccagccaacgccctccgcatgcaattaacacttcattttcaagtcgaaacctatacacccccacaacaattttagaagctggttagcttttattcaatcatcgtattttggtcaagttctaagaacttcttagagatctctagagaggtgggctatggacgaaaacctaaaaaacctctattgtaaatatgttttcatatcaaaatgttcctaaaggcaaaagatgacagcagatgaggtagggaaaaatagctttgcaaaaaaagaagaacaggttttgaagttttggaaagacaatcaaatttttgaaaagtctttgcaaaatcgtcagggaaaaaccctatattctttctatgacggccctccttttgctacaggtcttccacattacggtcacttattagcaagtaccattaaggatgttgttggacgctatgctaccatggacgggtactatgtgccgcgacgttttggctgggattgccatggggttcctgtggaatatgaggtggaaaagtctctgagtttaacagcacccggagccatcgaagattttggtatagcatcctttaacgaagagtgtcgtaaaatcgtatttagatacgttcacgagtgggaatactatatcaatcgtataggacgttgggtagatttttcttctacttggaaaactatggacgcttcttttatggaaagtgtctggtgggttttccaatctctatataaccaaggattagtgtacgaaggtacaaaagttgtccctttttcaacagcattaggaacacctctctctaattttgaagcaagccaaaattataaagaagtcgatgacccgtctcttgttgtaagaatgcctcttcagaatgattccgcatccttgcttgtatggacaacgactccatggacattgccttctaatatggctatagctgtaggggaaactctggtttatgtccgtattcaagataaaaaaagtggagagcagtggatcctaagtcagggatgtgtttctcgttggttttcaaatccagaagaatttgtaattttagagagtttttctgggaaagatcttgttggtaggacttatgagcccccttttacttttttccaatctaagcgagaggaaggagcttttcgtgtcattgcagcttcgtttgttgaggaaagtgaaggaacaggagtcgtacatatggctccagcgtttggtgaaggagactttttagtttgtaaggagaaccatgttcctttagtctgtcctgtagatgctcacggaagttttacagaagaaatacctcaatatcaagggcaatacattaaacatgctgacaaggaaatcatcaagttcttgaagaaagaaggaaggattttttaccacggaacagtaaaacaccggtatcctttctgttggagaacggatactcctttgatttataaagccgtgaattcttggttcgtcgctgtagaaaagattaaagataagatgcttcgtgctaacagctcgatccattgggttcctgaacatatccaagaagggcgttttggaaaatggttggaaggcgctcgtgattgggctatcagtagaaatcgttattggggaacgccaattccgatttggaaaagtgctgatggcgagattcttgttgtaggatctatccgagagctagaagaacttacaggaactcagatcacagatattcataggcattttattgatgatttgaacattgtcaaagatggcaagccctttcatcgaattccctacgtttttgattgctggttcgactctggagcgatgccttatgcccaaaatcattatccttttgaaaatcaaaaggaaaccgaagaggcatttcctgcagactttattgctgaagggttggatcagacgcgaggatggttttatactctcacagtgatttctgcaattttatttgatcgtcctgcatttcgtaatgccattgtgaatgggattattcttgcagaagacggcaataaaatgtcaaaacgtctaaataattaccctagtcctaaatacgttttagatacttatggagctgacgcgcttcgtctatatttgcttcatagtgttgtcgtaaaggctgaagatcttcgcttttctgataaaggaatcgagggtgttttgaagcaaatccttcttcctctaacgaacgtactttccttttttaatacctatgccgagctgtatggttttgatccgaaatcacaagatatagaaccagcttatacagagattgatcaatggattttatccaatttgtatagtgttgtaggtaaagttcgtgagagcatgagtcagtatcatttaaactttgctgtagaaccctttgtgacctttattgatgatctgactaactggtatatacgtcgctgtcgtagacgtttttgggaagctgaagatactcctgaccgtagagctgcattttctactttatatgaagttctcacagttttttgtaaggtaattgctcccttcgttccttttcttgccgaagatatctatcagaagttgaagttagaaaaggaacctgaatctgttcatctctgtgattttcctcaagtcgagatggataaaattctccctgatctagaaaagcgtatgcacgatattcgggaaatcgtaggtttaggccattctttaagaaaagaacacaagttaaaagttcgtcagcctttagcaaacttttatgttgtcgggtctaaagatagattgtcgcttctaaaaacatttgaagggttgattgctgaagagctgaatgtgaaaaatgtgattttctatgaagaagctccgagtttcatttatactaccgtcaaacctaattttcgtatgcttgggaaaaaagttggatctaagatgaaagaggtccaaaaagctctcagtgaactgccaaacaatgctatagataagctgattcaggaagaaacatgggttttaaccattgatgatagagaaatagctttggatggtgatgacgtcgtgatttgtcgtcacacagatcctggatatattgcccgtagttccgctctatttagtgtgattttagattgccagttaagagaacctcttatagtcgaaggtatagcaagagagctagtcaataagattaatactatgcgtcgaaatcaacaacttcatgtttctgaccgcatcgcattaagaataaaaaccacagaggctgttcatcgcgctttcttggattatgaaaactatatttgcgaagaaacgttaattatagcctatgattttactcaggattctgatttccaaggggaaaactgggatattaatggacatgcaacgcaaattgaaattacagttagttctatagattcttagagattttctagaaacaactgaaaaaccataagaatggttatttcttgtggtttttctcctctttcttaggaaagagtctgcgtcgtttttgatagtagacatatccaatgagagagagacccgtcgctaatgctatcccactaacaagataacctgagagtgttgttggagcagaaactccagttaaccgtcccatgcgtccaataggccagaatgtacatagaggagatcctaagagattttccataggaacaaagccaaattctcgactatccgcactcatagggtagttatctcccaagacgagaacatgacctttaggaacttgaataccaaaattatgtataaactccacgaattctttaaaatcttctggagggagtcccttgtcaacaaaagctatatagggttgtgtctctgaagacccctcttgcttttccgtttcagaagtcacaaatttttgcagagttggatcattctttataaatacaggagaatccatgatataaagattcccttggttaaagaatgcataacggttaggtaaaggtgcttgcagcggattcacaggattataaatagaactaaagttgatcccgcagttaaaaagttcaatcacttgcttatcattgagctgagtaagggggtgagaagattttagcttataacgaatctctccaaagccaatttgatacgcttcgcctttagaatattcataacaaccatcagggaccttgggcaggagaattgcataggctttggcaattcctgaagtgttaatcttgaattgatggtatttatacgcacatccttgagcaacaataaaacgagaggtagtaagattgttccgaattaagtgcaaatgttccttacgcaaaggaagtaaagtcttcataggttgaatcgcaggcgagagctgatgctcatagtgacgcaacagaggctttgggtaggaaaggttcgctgtatggcaaatttctaagtagactttagttggacttcctggattcggaagtagatgggatgttcgtgcctgatgttctgttaagatgcgcaccatagcatagttacccataccaaaaagatcggcatagctgactggcgaaagatgaggatcttttaatttattaggctcgtcttgatgccattctttatggtcaaagaattgtccatacatggaggtttgagggaaaatcagccgaccataactttgattgaactgcttaaaatctataattgttttctgcccttctgtatggctgctggtagtgccatcaaaggatatataggggacgtgatataagttttctaaaccatggacagaaggaaactctatgcgtttacctgcatcatcaagaccataaatttttcctccatagaaatataagaagtccccaggtcttcccatgcaacgtttaatgtaacgcttttttcctggaatcaatccgaagtactttgtatcagcatctgggatagggaggtcgcctacagtgaaaacaacaagacccccgcgagttacggattcaggattgaaggcaagtggtttcttagcaaaagggcaatggagaccaaatgttgttttggatacaagaatccgatcctgttctaaaattgtaggcctcatggatcctgtaggcacttcataaagttcaaaccaaaattgccgaactaagaaggctacaacaccagcaaaaagaagggccttgataagctcataggttttgcgtccgaaggaattaggataacggttggaaaatgctaatgcttgctgagctaagtcgcttgcagtttcttgatcatgttcaaagatagcctcttctagttgttctagtagttcttgcagttgctttttatctgcaggggaatgggcgagttttttactttttaaaagcttataagtactgcggaggatatgacgacttttatttagagaatagtgttgtttcataaagatactggggtaagaaagtcagattctatctctttagattgattatagaacggctgcattggatactttagagctaatggagactgaagacctaaatgaaaaatcaaaacaatcctcgagctaaattcgtaagtacattctagcgtattagatttttcgatccaaaattattttgctatattgttagatcttttcattgtgtcttagagtcaggaagagaatagacatagggagaagttgccccgtgtcctatatccacagctcttactatagaagtccctttaggagtctcgatactcacccataaaggaaacacagaaatgtcaggttgggtgaaatacataaggattcctgtttctgataaggggcctcgatctttaggccagagcccctgccatgcattcacagagattgacgtgagtggagccccttcaaaagaaactttgggagaccagggcttgttttcttttcctttagtcttgattacgtttgcgggagctggagataaaggaagatcaaagatttgcaagaaggcaggaactgtagtggattttcctacaggctctaggctcttggttcgagtgtttaaagagaaaaactgagaaccttcagaagagagcgaaacaacaaagacttgtgaaggtgattccagttgatgaatgaccgttttccaagaagcttgttctaaagaagggcgttctttatgggcgatacagggaaaatggatgatctctatccaaacggttttaggggttgttgatttgactaaaacaaacgttctttgagaccctcgacttaaaacagtatagtctccagtcttagcaagaaaaatattttcttgaattgttcgtaaagaactagtttgagaggcaaaaagaccagaaaaagccgtcgagaagaggaaagatagaaagaggaataagaagagtgtttttccttgctttttcataagatatttctgtagaatcctctcgaagtatgtcgagctatcatttggcataataggatagcgattttggagttgtcaatatgaaaaaaaatacccaccctgaatatagacaggttttatttgtagattcttcaacagggtataaatttgtttgtggatctacctatcaaagtgaaaaaactgaagtttttgaaggtaaagagtatcctgtatgttatgtcagcgtatcctcttcttctcatccttttttcactggaagtaagaagtttgttgatgctgaaggtagggtagataagttcttaaaacgttatagtaatgtaagacagcctgcacagcaacctcagcctgaagaagacgcactacctgctgctaaaggaaagaaaaaagttgtaactaagaaaaagaaataaaacttcttttagatttcccatttataaaacccattctcaggctctcaagcccgagaatgggtttttttgtgagggctttctctcttgcaatagcttgtataatacgttatgctttcctaggtcacgataattttgaaatagataacgttagatgcctgtatcagtataccaaggtgttttagagaattttttatctgattccatttgatactgatttttcaccactttttagggattcatgaagaaaaaagttgccgagtatttaaaccgtttagcagaagtcgaaataaaaatttcaaatcctgaaattttttctaattctaaagaatatagcgctcttagcaaggaacattcttatcttctagaattgaaaaacgcctacgataaaatcttaaatttagaaaaagtccttgctgatgataagcaagctttagctattgagaaagatccagagatggtcgttatgcttgaagaggggattaacgaaaataaagtagagctagagaaattaaataaaatattagaaagcttattagtccccccagatcctgatgatgatctaaatgtcattatggaactacgagccggtacaggaggcgaggaagccgctctctttgttggagattgtgtccgcatgtatcacctgtacgcctcctctaagggatggaaatacgaggtactctctgcgtcagaatccgatcttaagggatataaggaatacgtcatggggatctcaggaactggggtgaagcgtttacttcagtatgaggctggtacacatcgagttcagagagttcctgaaacagaaactcaaggacgtgtacatacatctgcaattacaatcgctgtccttccagaaccttcagaagaagatacagagcttcttattaatgagaaggatttaaaaattgatacattcagagcctctggtgctggaggacagcacgtaaacgttactgattctgcggtgagaatcacacacctgcctacaggtgttgtagttacatgccaggatgagcgcagtcaacataaaaataaagataaggccatgcggattcttaaagcccggattcgtgatgcagaaatgcaaaaacgccataacgaggcgtctgctatgcgttctgctcaggtaggaagtggggatcgttccgagagaattcgcacctataatttttctcaaaatcgcgtgactgatcatagaatcggattaactttatataacttagataaagttatggaaggagacctagatccaattacgactgcaatggtgagtcatgcctaccaccagttactcgaacatggaaattaaaaaggcgattcaagagggaaccgcttacctagattattatggggtgcctctttctgattgcgaagccctgtatattctcatggatttattagaagtcagttcaagggcaaagttattcgatcttgttggaattagcgaaacgatgcttatggagtatcgaaagaggctagctttaagggggcaacggtgtcctactgcatatctcaatggtgccgtgagttttttgggattaagattgagagtggattctagggttttaattcccaggacagagactgagctgcttgctgagtatattatcaactatcttttatctcattctgagattcaaactttttatgatatttgttgtggtagtgggtgtttagggctagctatcaagaaatcctgtcctcatgtggaagtggtgctttcagatgtttgtccgcaagcagttgccgtcgcaaatgaaaatgctaaaagtaatggtttggatgtaaagattcttctaggcgatttgtcagccccctacactcgtcctgcagatgcttttgtttgtaatcccccctatttgtcttttaatgaaattattcatatagatcccgaagtgcgttgttacgagccttggaaggctcttgttggaggttctacgggtttggagttttatcagcgtatcgcccaagaattgcctaagattgtaacttctacaggagtcggttggttggagattggatccagtcaaggagaaagtataaagaatattttttcgaagcacggaatttatggccgtctccatcaagatttgtctggacgcgatagaattttttttcttgaaatggatgggagagatcctgtatcctcgggggcttattcttgattttttctggataaatgattaattctttatcgcaaaagctatcttctattttttcttttttggtttcttctcgtagaattaatgaagaaaatatttccgaatctattagagaagttcgtctggctctcttggatgccgatgtaaattatcatgtagttaaggattttatttctaaagttaaagaaaaaatccttggagaagagatctggaagcatgtttccccagggcaacagtttatacgttgtttgcatgaggaattagtagcatttttaagcgatggaagagaagagtttactattcagaagacgccttcgatcatccttctttgcggactccagggggcaggaaaaacaacaacagctgctaagcttgctgattatgtaattaagaataagaaagcaaaaaaagtccttgtggttccttgtgatctcaaaagattcgctgctgtagatcaattaaaaattttggttgctcaaacgaaagctgaattttaccaaagtcaagagaacaagcctattaatgttgttgttaaagcgcttgcatatgctaaagaaaatggtcatgattttgtgattctggatactgcagggcgtctcaatatagataacgagcttatggaagagctgacggcgatacaaaaagtttctcaagctaatgagcgtctttttgtgatgaatgtagctatggggcaagatgttttagcaacagtgcaagcttttgatcagtctttagatcttacaggcgtgattctttccatgactgatggagatgctcgagcaggcgctgttttctcaattaagcacgtccttggtaagcccattaaatttgaaggatgcggagaacgcattcaagatcttcgttcattcgatcctcaatctatggcggaacgcattcttggaatgggggataccataaattttgttaaagaaatgcgcgagtatatttctgaggaagaagacgctgagctaggtaaaaaactagttactgcggcttttacttatgaagactattataaacagatgaaagcatttcgtcgcatgggacctctaagaaaacttttgggaatgatgcctggttttaataatgcgaaacctagccaaaaggaaatcgaggattctgaacaacagatgaaaagaacggaggcgattatcctgtccatgactcctgaagagagaaaggagttggtggaattggatatgagccgtatgaagaggattgcttctggttgtggtttaactttaggcgacgtgaaccagtttcgaaaacagatgtcgcaatcgaaaaaattttttaaaggaatgtctaaaggcaagatggaacaagttaggaaaaaaatgtcaggaggaaatcagtggcgttaaaaattcgtttaagacagcaagggcgtagaaatcatgttgtttatagattagtgctcgcagatgtcgagtctcctcgtgatggtaaatacatagaattattaggttggtacgatccacatagctctataaattatcagctgaaaagtgaacgaattttttattggttagagaggggagcccaactttcttcgaaagctgaagctttagtaaagcagggagctccaggagtgtatagtgcgctattgtctaaacaagaagctcgtaagttagttgttcgtaagaagcgacgtgcttatagacagcgtcggtctacacaaagagaagaggctgcaaaagatgcaactaagtaggtagtgaactgggatgaagatcgatatactttctttattcccaggttattttgatggtccattgcaaacgagtattcttggtagggccataaagcagagactcttagatgtccagcttacaaatcttcgtgactttggactcggaaagtggaaacaagttgatgatactccgtttagtggtggtgggatgcttttaatggcagagcctgtcacttcagctattaggagtgtaagaaaggagaattctaaggtaatttacctctctcctcaaggagctttgttgacagctgaaaagagtcgagaattggctgctgcttcgcatttgatattactttgcggtcactacgaaggtattgatgagcgtgctatagagagcgaagtggatgaagagattagtataggggactatgtcctgactaatggtggaattgctgctctggtccttatcgatgcagtttctcgttttattcccggtgtattggggaatcaagagagtgctgagagagattctttagaaaatggtttgctagaaggacctcagtatacacgccctagagagtttgaagggaaagaagttccagaagtattgttgcaaggggatcacaaagccatttctcagtggagattggagcaaagtgagcgtagaacttatgagagacgtcctgatttgtatctgaactatctctataaacgctcgattgatcacaaatttgatgaggagactacaacaaatagggatcatttcaagtgtgacaagatttctgtagtactagaggtaaataagttaaagcgcgcaaaaaatttttactgtaaggtattcggtctggatgccatgagctgcgagaataaattttgtcttcctcatgaaggcaaaaccatattctggttacgagaagttcaagctgagaaaaaaaacatagtgactctctccctttccttagattgtgcatgcgaagaggacttttgttatcttcttagaagatgggagttatttggtggaaagttgttagaaaagcaagctgatgagcatgctgtatgggccctagcacaagatttagatgggcatgcatggatattctcgtggcataggatgaaatagaagaaagagaattttaggtggtatattatggtgaatttactcaaagaattagaacaagaacagtgtaggaatgatcttcccgagtttcatgttggcgatacaattcggttagctacaaagatttcagaaggcggtaaagaacgagttcaggtatttcaaggtactgtgatggctcgtcgaggcggcggctctggagagactgtatccttgcatcgtgttgcttatggtgaaggcatggaaaagagtttcttgcttaatagtcctaggattgtaagtattgaaattgttaagcgcggtaaagttgctcgagctcgtctgtattatctgagaggaaaaactggtaaggctgctaaagttaaagagtttgtaggacctagatcttcaaagaaatagtctgtagcaagacttcatattgtcttattttgatttttataatctatagtagcttatgaatacttctatttctgaaattcagcgttttctttctatgattgcttttgagaaagagctcgtctcagaagattttagtgtcgtcgctggaatagatgaagctggaagagggccactggcaggtcccgtagttgctagtgcctgtattttacctaagggaaaggtatttcctggagtaaatgatagtaagaagctatctcctaaacaacgagcccaagttcgggatgctttgatgcaagatcctgaggtctgttttggtataggcgtaatttctgtagagaggatagatcaagttaacattttagaagccactaaagaggctatgcttcaagcaatatcttctttaccgatatctccagatattcttcttgtggatggtctttatttaccccatgacattccttgtaagaaaatcattcaaggagatgctaaatctgcatccatagcggcggcttctattttagcaaaagaacatcgtgatgatttgatgttacaactacacaggctctatcctgaatatggatttgatagacataagggatacggaacttccttgcatgtagaagcaatacgacgttacggtcccagtccctgccataggaagagcttttctccaataaagcaaatgtgtgctattgtatgaataagatcctagttgactctcctttttctccagatcaccagaagtgctgtcctaagctttttacaattagtgctcctgctggagttggaaagacaacacttgtccgtatgttagagcaagagttttcttctgcttttgctgagactatatcggtaacaacaaggaaacctcgagagggtgaagtcccaggtaaagattatcattttgtttcccacgaagaatttcaaagacttttggatcgtcaggctctcttagaatgggtgttcttattcggagagtgttacggaacaagtatgttagagattgaaagaatttggagcctagggaagcacgctgttgctgttattgatatccaaggagccttgtttattcgctctcggatgcctagtgtatctatttttattgctccaccttcacaggaggagttagaaagaaggttagcttcacggggatctgaagagggctctcaaagaaaagaacggctggagcacagtcttattgagctagcagctgcaaatcagtttgattatgtcattattaacgacgacttaaatcaagcgtacagggttttaaaaagcatttttatagctgaagaacataggaacatattatgattaaaaaagatcgtttcactaatgaaaagttaaataagcttttcgatagtccttttagcctagtgaactacgcgattaaacaagcaaagatcaaaattgccaaaggcgatgttcgctcctctaatgttgcgatcgaaacactcgtcttgttagatagagaagggatacagcctgagtttactgaagagattgtagtaactgctagccctactgtggaaagaaagagatcagaacatacaaattctagaaaaaaagatccctcagcatatacttggagtgatgtaaagtaatgccacaaaaagtcctgattacttcagctttaccctatgctaatggtccgctacattttggacatattgcaggagtctatcttcctgcagatgtgtatgcaagattccgtagattgttaggagacgatgtcctttatatttgtggttccgatgaatttggcatagcgatcaccttaaatgcggatcgtgaggggttggggtatcaagagtacgtggatatgtaccataagttacataaagatacttttgagaagttagggtttgctttggatttcttttctaggacgacgaacccttttcatgctgagcttgtccaagatttttattcccaacttaaagcgtctggattgattgaaaatcgcatatctgaacaactgtattcagaacaagaacaacgttttcttgcggatcgttatgtagaagggacgtgtcctcggtgcggttttgatcatgctcgaggagacgagtgtcagagctgtggtgcggattatgaggctatagatttaatcggccctaagtctaagatttctggggttgagttagtaaaaaaagagactgagcactcatattttcttttggaccgtatgaaagacgctctactttcttttattcagggatgctatttacctgatcatgtccgtaaatttgttgttgattacatagaacatgtcaggtctcgagccattactcgagatttatcttgggggattcctgttccagactttcctggaaaggtgttttatgtatggtttgacgctcctataggatatatcagtggaactatggaatgggcagcttctcaaggaaaccctgacgaatggaagcgtttctggcttgaagacggtgtagagtatgtccagtttataggtaaagataatcttcctttccattctgtagttttcccagctatggaattgggtcagaaacttgactataaaaaagttgatgccctcgtagtttcagagttttatcttttagaaggacggcaattcagtaaatccgagggcaattatgtggatatggacaagtttttgagttcctattccttagacaaattgcgctatgtattggcggctacagctcctgaaacttcggatagtgagtttactttccttgattttaagactcgttgtaattctgagttggtaggaaagtttgggaattttataaaccgagttcttgcttttgcagaaaagaatcactatgacaagctttcttatcattctgtggttttagaagatagtgacagggcatttcttgaagaagcgcgtcaacttgttcgagatgctgagaagtgctacagagagtatagtttacgtaaggctacgagtgtgattatgtcactggcagctttagggaatgtctattttaaccaacaagcaccttggaagctattgaaagaagggactcgtgagcgtgttgaggccattttattctgcgcatgttattgtcagaagttgttagctttaatttcttatcctattattcccgaaagcgctgtagctatttgggagatgatctcaccaaaatctttagaaaattgcaatttggatacgatgtatgctagggatctatggaaagaagaaattcttgatgttataaacgaagaatttcatttgaagtcccccaggttattatttactactgtagagtagagctcgaggtcttttctttttagaatcctgatctgtaggtgtaattacagatctgcataatttttcttagtatcgagctctttaagaacttctgctagtcctgtacatcggtgttgcactcgattatttcttgttgcaatagcaatggctttttttgtcccaactagaatcaccaattttttcccccgcgtaatagcagtatagagaagatttctatagagcatcataaagtgcgaggtatgaataggaatgataatgcaggggctttcacttccctggtacttatgtactgaggtagcataggctaagactagatcgtcaagctctgagaaagaatagccgacatgctttccttccatacggacaacaacagctttatcttcgaagttgattgtagagacatagcctatatcgccgttaaagacttctttattatagttgttgcggatttgcattaccttatcgccaacggcataggattgaaatctaccgtgaagatttgcttttttagggtttaatgcatgtttgagtgctttatttagattatagattcctagggttccttttttcatgggagctagtacttggatatcttgaggatagatatggtatttttgtgggacgaattttgtcacaagatgaatgatatgattgagagcctcttcttgatcatccttttggaaaaataagaaatcacgacgccctgtttctgaatataatatggggagttccccttcatttaccctatgggcattcgtaacgattcccgaatcatgaacttggcggaagatcttatttaatctgatgactgtcattttattcgaagtaatcaagtctttaaggatatttcctgggcccacgctgggtagctggtgaatgtctccaataaagacaagagttgtgtagtcaggaagtgctttcaggaagtggtgcagcaagtgcgtgtccatcattccggattcgtcaacaatgatcagatcacagtctataggattgtcatggttcttgcggaaagatttcgttttaaaatcatactgtagcagagcatgaatggtgacggagtgtttttgtgtaatttcggtcatccgtttagcggcttttcctgtaggagctgcgaggatgattttatgagtcacctgttcaaaaattttcagtattgcttgggtaatggtactttttccagttccagggcccccagtaatgatgagaagtttttcagaaaaacaggctttaattgcttctcgttgttgttctgcgagatctatacttaggttttcctctacccaagcaattgctttttctccgtctatagaacggattctcctcgaagaaaataaaatgcgcttgagatcagaaacaatagttttctctgcgagatggagataacgtgtccagacatggagtgtcccagaaatgtcttgaatatgtaaaagcttacgcttttgcatattgaggatttgcgtatcgatttcttcgagagtaataggagtatcaaagacatcttgatttaatagtttggcgacgacatctatcaggagctctatcggatagcaagtatgaccttcttcttgaagttcttctaaggagtgctggataccagcacataggcgactttcagaatttctggggacgcctagtttcatagctatgaaatcagcagttttgaatccgatgccctccatttctctggctagaaggaagggatcttcgcaaattttttctatggatttctcttggtattttttaaaaattctcactccataatgaatcgggatattgtattcttggagaaagagaagagttttccttaagattttttgctcgcagagttgtttgcaaatagagacacatcgtgtttcgctaattccagaaacctcacttaagcgttctggagtgatatcgaggacataacatgttttctcttgaaatttctcgatgatcttttctgcgattttagggccgattcctttgatgagttttgaggtgaggtaatggaatacgccacgatattcataaagaagaggagagtcgtaactatggatttggaaatacttagtatttgaaggggaatggctccagacaccatagatttggatcggggatcctagttccaaaggttggggaagtttgcctttaattaggataggagtcgttttattgggtattttgatataagcagtaatgtccccagagtctttgttttcaacaagtatttgctctaagtatccgcagattttctccatagaattctaaaatcttgttttcctggaagatgaagtagcttaaggaatctttataaaaagcttctaaaaagtatggattataaactttttgagataaaaacgagacatcccaaggcttttaattttgggataaacttatcaaagaattattttatatagtaattatttcctcgtatattgttttttgccctaggacgcaaaatctatcctaccgaagaacctttgttattacaacaatttttataacaatagattgattaggaaagatcgatgttcccttgtgcaataggttcatgttttatcagaacacgagtttcttttttaattcttttttcttttgctattgcattcagctccatgaggagagcttgagtacgattttatacaaactgggatagggattgcctctatccgtgttggacaaatacctaagaagattttgattccggctttccgactatatagagaagaaattcctaaggcactttaattaaaaggtttattgccatattcttgccttgaaaatttttgattatagattttggtattgaacaatgactagtgcagtaaaaacctcatcactcatccaagtgactcaaccttaaatcagaagtaaacaacgtacagttgcaattacgctccttgtgcttggcattcttttgattgcttctgggattatttttctagctgtcgctattcctggattgagttcagcagttgccttaggattgggctgtggtatgactgctttaggaactgttttgttgattacaggacttgtcttgctgatcaggagtgagaagctcgctctagaacaagtagaaataaagcaagctaggaccagggtgaataatgagttagatcaactcagtcagtatgttttctacacagaaaatgttttagataatttgaagcgttggtcgtatcgagatttaggttttgtgagacaggcgcaagaggaggttacaaatttagagcaagacattgaagaaattttcttgacgttgcgagatattagaaatgctcttgataacgaagagttttttatgactcatgcgaaacagtgtttagcccaagtcggagaaagcttatttcaggatgctagtatagatgagtttattaatttggctcatctatccgaaatacgtcagcatttggatatcaatgatccgagatggtctatgattacaaagaaagttaaaggcactgtggttcggtttatctatgtctctacaatgtataaacaaataaaatctaattttgaaaaaagtgacttcggacaacttaggaagatgctactgaacaattacaaaacaatagaagaggtcttgtatcagagttttcaaaagggctacaatagagccgctttgttgagtgaaaagacaagaattattcatacgagttctcttttgcattgggaaaaggacgaagataagcatcttaatattaagaacgagtgtgcaagtcgtcttgagaatttcaagaagtttagaacactatttcttggattatcagaggaagacgttattgactttactggagcgtctggttgggattgttccaaactgcctcggaaagaggtcccgcttgatggtggcaagaagaaactgaggtttaaaagaacctttgcagatgaacaagtcggagattgggatcgcactacgtctcttgagcatatgacacctcaagaggaagatcctttagacaggttaatggatcaggttgaacaagaggctacttcagtcttaaaagatcaggatcgttattggaaagagatcgagacaagcgaagcaaagtttaggtccctgccacgggaagatgattttgaaaagcagtcacagattgatagttatattcgggatttggacgaccatttatcggtttgggcgaatcagttatctgctgcagaagatgctttgatagaggttacagatgtgcaggaacatggaaatagagaaatgcttaagaatatacaacagggactggagcttattgaagatgctgtaaaagctactctacctagagttgactttatacaagagcttttagagaaggaagagcttccgttggttgctgctaggatgagtttagagaatagttagaagataagcagctgtgcagagattatgtcagaagtgaagcctttgtttttaaagaatgactcttttgatttggcaactcagagattccagaatctaattaacatgctacaagagcaagccgagatatataacgagtatgaagaaaagaatgctagggttcagaatgagattaaggagcaaaaggactttgtgaaaagatgcatagaggactttgaagccagaggactgggggtgctaaaagaagagcttgcatctttgacgcgtgatttccatgataaagcaaaagcagagacttctatgctcattgaatgtccttgtattggtttttattatagtattcatcaggaggaacaaaggcaaaggcaagaaaggcttcaaaagatggctgagcgctatagggactgtaaacaagtcttggaggctgtccaggtggagcaaaaagatatgatatcttctagagtcgttgtcgatgacagctactttgaagaagaaaaagaagaacaaaaggtggataacagaaagaaagaacaggactaggtctatttttctacagcttttcccgtagggggaggggagttctagaattttttctgtcgcctattcaagataacagtgttgttttgtggttttaaatttagacattacactagctttaaagtttgagccctcccccgctttaagatcgctttctgaagctgagtctaaggtacaaacttttgctataggattattagttattggtattctcatactattgcatgggattattttttttctctggagctatttctagttgtggtcttttagtgtctctaggagttggtttaggacttagtgttttaggagtacttttacttctcttagcaggtcttttgctttttaagatccaaagtatgcttcgagaggtgcctaaggctcctgatctattagatttagaagatgcaagtgaacggcttagagtaaaggctagccgttctttagcaagcctcccgaaggaaatcagtcagctagagagctacattcgttctgcagctaatgatctaaatacaattaagacttggccgcataaagatcaaagactcgtcgagaccgtgtcacgaaaattagagcgtctggcagctgctcaaaactatatgatttctgaactctgcgagattagtgagattcttgaggaagaggagcatcatctaattttggctcaggaatctctagaatggataggtaagagtctattttctacctttctggacatggaatcttttttaaatttgagccatctatctgaagtgcgtccgtacttagctgtaaatgatcctagattattagaaattaccgaagaatcttgggaagtagtgagtcatttcataaatgtaacgtctgcttttaagaaagctcagattctttttaagaacaacgaacattctcggatgaagaagaagttagaaagtgttcaagagttactggaaacatttatttataagagtttaaagagaagttatcgagaattaggatgcttaagtgaaaagatgagaatcattcacgacaatcctctcttcccttgggtgcaagatcagcagaagtatgctcatgctaagaatgaatttggagagattgcgcggtgtttagaggagtttgaaaagacgttcttctggttggatgaggagtgtgctatttcttacatggactgttgggattttctaaatgagtctattcagaataagaagtccagagtagatcgagattatatatccacgaagaaaattgcattaaaggatagagcccgcacttatgctaaggttcttttagaagagaatccgactacagagggtaaaatagatttgcaagacgctcaaagagcctttgagcgtcaaagtcaggagttttatacactagagcatacggaaacaaaggtgagactagaagcacttcaacagtgcttctcggatcttagggaggcgacgaacgtaaggcaagttaggtttacaaattctgaaaatgcgaatgatttaaaggagagtttcgagaagatagataaagagcgtgtgcgatatcaaaaagagcaaaggctctattgggaaacaatagatcgcaatgagcaagagcttagggaagagattggggagtcgcttcgtttacaaaatcggagaaaagggtatagggctggatatgatgctgggcgtttaaaaggtttgttgcgtcagtggaagaaaaatctccgcgatgtggaagcccaccttgaagatgcaactatggattttgagcatgaagtaagcaagagcgaattgtgcagtgttcgggcgaggctcgaggttctagaagaagagctgatggatatgtctcctaaagttgcggatatagaagagttgttgtcctatgaagagcgttgtattcttcctattagggaaaatttagaaagggcatacctccaatataataagtgttctgaaattttatccaaggcaaagttcttctttccggaagacgagcaattgctagtttcggaagcgaatctaagagaggtgggtgcccagttaaaacaagtacagggaaaatgtcaagagagggcccaaaagttcgcaatatttgaaaagcatattcaggagcagaaaagccttattaaagagcaagtgcggagttttgatctagcgggagttgggtttttaaagagtgagcttcttagtattgcttgtaacctttatataaaggcggttgttaaggagtctataccagttgatgtgccttgtatgcagttatattatagttattacgaagataatgaagctgtagtgcgaaaccgccttttaaatatgacggagaggtatcaaaattttaaaaggagtttgaattccatacaatttaatggtgacgttcttttacgggatccggtctatcaacctgaaggtcatgagaccaggctaaaggaacgggagctacaagaaacaactttgtcttgtaagaaattaaaagtggctcaagatcgtctttctgaattagagtcaaggctgtctaggagatagtaaaaaagttgagttctttgcgcagtgtttttgatggattattcgttagaagacgatacttgagagttttccaaacttttctgtacttttcttccgaagagaactaggcagaggaggcttcctcctaacattagaaagattcctataccttcttgtagagaaggaagactttgtgagtagagataggtaagcacaaggccaaaaattggttcaaagattaatatcgcccctagcaatgctggtgagagattcaaactagctttattccaggctattaaagcttttgctgaggaaaatattcccatagcactacatagcaacaagaagagcagtcgctcggatcccggtgtatgcgagataagattgtgtgttacgtgggtaattccacagagatcgagaataataatcatagggaggcagatgatcaaagcgctgattccgatgaggtagctccaggtatctggagttaggttagggtgtttttcgagtagcgattgattgcggatcacatagattacccaaagacttgttgagagtatgactgcaatgactcccaagatagagtagagaggagaggcggctgttggcaagttgagtgcggagaggtgtgtcagaatcactcctgtgatgatcacactgctgatagcaaagagtagagaataggggagttctttttgctttgtattggagtggtagagtacggcggttggagccaggctggcgatgactacagtgattgcggatccaacatagcggatgccaagggtgattccgaagtaatacacggggttaatcagcagtgtccagaggaggctttttctccaaatatataaaggagtttttttaattacggagggattttttatagcgcaagcaatcagggagaaaataccaaaaatggtataacgggtaagtacaatatcaagatcgccaaacgaaccgaggaagtttggtatgacaaagacgattccccagtataggcaggcaacgagcccatggaagatgcctaggggtacattacgggttctggattcttgatttgcgctggggaacataaagctctcttaagggtatgagcaatagaattgcctacaattttaacatggtagggatttttgttggtattgagactttaaataatacgaatcgcttttctgttcgagaggaaaataagaagataggggaagaatgttaaggaatcaggtacttgtttactgtagtgagggtgtttctccttattatttacggcatacgatacgttttctcaagtactatagcactcaagaaggtgctttcgatattcttagggtcgacgggaattttttgattaagaatcctttttgggaagaaacgacgcgcttattggtattcccagggggtgcggaccgcccctatcatcgtgtacttcatggtttaggcactgcccgtattttccaatatgtttctgagggagggaattttctagggatttgtgctggggcatattttggttctaagatgatttatttttatgagcctgagggagcgccgttgcaaggggctcgagatctagggtttttcccggggactgccaaaggtcctgcttatagggggaatttttcttatgtgagtccttctggtgtaagggtttcacctcagttattttcagattttggcttggggtatgcgatgtttaatggggggtgttttttcgagggctcggaaggatatcctggggtgaatatcgaatctcggtatgacgatcttccagggaagcctgcgagcatagtgtctaggattgtcagtaagggcttagcggttctttcaggacctcatatagagtatcttcctcattactgtcgtatggttaaggagaacgtccagaaaacacgtgaattcctccaaagggagcgtacaactttggaccgctattgtcagaatcttgtacagcgtttgcgtcagcctgcattttcgaaagcggactgctgaagatctaaattaggcaatcgaaatcatcagcgtgtatttttgtcgtatcgaactcggtgataagctgatataggattgggctgcaaagaactatggagtgcgttaggacatttcggatgttattggaggcataagacatctcttcatagccgtggagtagtccaaacgattgaatttgtggagctgtttggctgtttttatatacaaagcgattgaaatagtctctaggttctatagtgtactcatcttcattatagtctaattgctcgaatacacacagaaaagcgagtagttccatttgtcttgctatgggatttgagcttcctgtgttaaggctatctatgagtagtatttgatttctttctaatgctgttgaaaataggttatggtagtggataaagaattttttgaaaattagatagagttggttcgagataggatcccattcagatcttagaatgtcaggattatgtactacagggaagtagtaggtgatttcatttgttgtggtttcgatgaggttattttcatactgcgttttgttctgcaagtcggtcaatgaaacttgagaggctatccctaagttgtttacatgtttttcttgtaatttttgataggttttttgtaaaggttcggaggtgacaaagattctcggatccatatggatatgagaaaggatatactgttcatcttattctaatattttccaattggcgagagcacttttaattaggaaatctggatctttaagaaagatttttttccattcttcgaaggatggaaaaaagagctcattttttaggtttatggatgttggatctaggagtagtgtttcggaggattgtattttatttttgagaggatttaggagccaggggtctaaagaaggtgtttctttaggaaaaatagattttggtttttgttcgtccttttgaacacttttcgagcactgtgttccaatgagcagggagattcctgtacttaggacgattatactgattagggacaatgctattatcaaaagagtatttgggagaagtccggagagggctatgagtatgcatgctgcaatccccaagaatagggaaagtatggcgagagaaagtttcgttatagcagcgaatttggattctggcagcagttgagcgggttttttattttcgtgtataattgaagaacacttgaccatagaagactatcaaagaaaatgcaaataataaattgaaaaatcgttgaaagaaggagtcgaagagaaaaaatactccggaggatgggttcgaaccaacgaccaatggattaacagtccactgctctaccgctgagctactccggaacagcttttactccctacatattctatgaccaaagggtaaaaagtcaatgattttcgtctctgaaaaaagaaagattttctttaagtcttgcaattttccttatatttttcttcactagtgcgtatgtttttccatcgatatgctttctggagttgtttatggagaatgctatgtcatcatcgtttgtgtataatgggccttcgtggattttaaaaacgtcagtagctcaggaggtatttaaaaagcacggtaaggggattcaggttctcttaagtacttcagtgatgctttttataggtcttggagtctgtgcctttatatttcctcaatatctgattgtttttgttttgactatagctttgcttatgctcgctataagcttggtattgtttctcttaatacgttctgtacgctcttcaatggtagatcgtttgtggtgttctgaaaaaggatatgctcttcatcaacatgagaacgggccttttttggatgtgaagcgtgtacagcaaattcttctaagatcaccctatattaaagttcgggctttatggccgtctggagatatccctgaggatccttcacaagctgcggttctattactttctccttggactttcttttcatccgtggatgtagaggctttattaccgagtcctcaagaaaaggagggtaagtatatagatcctgtgctgcctaagttgtctaggatagagagagtctcacttttagtgtttttgagtgcatttactttggatgacttaaacgaacagggagtcaatcctttgatgaataatgaggaatttttattttttataaataagaaagcgcgtgagcatgggattcaggatttaaaacacgagattatgtcttcgttagagaaaacaggagtgccattagacccctcaatgagttttcaagtttcacaagcgatgttttctgtatatcgctacttgagacaaagggatttaacgacttcagaattaagatgttttcacctcttaagttgttttaaaggggatgtggttcattgtttagcttcatttgaaaaccctaaagatttagcagattctgactttttagaagcttgtaagaacgtggaatggggtgagtttatttcggcatgtgagaaggctcttttaaagaatccgcaaggaatttccattaaggatctaaaacaatttttagtgaggtaatctatgatcgagtttgcttttgttcctcatacctccgtgacagcggatcggattgaggatcgcatggcctgtcgcatgaacaagttgtctactttagcaattacaagtctttgtgtattgatcagttcagtttgtattatgattgggattttatgcatttctggaacggttgggacctatgcatttgttgtaggaattattttttctgtgcttgctttggtagcatgtgttttctttctttatttcttttatttttcttctgaggaatttaagtgtgcttcttcgcaggagtttcgttttttgcctataccagctgtggtttctgcattgcgttcctatgaatacatttctcaggacgctatcaatgacgttataaaagatacgatgcagttgtctaccctttcttctcttttagatcccgaagcttttttcttagaatttccttattttaactctttgatagtgaatcattcgatgaaggaagcggatcgtttgtctcgagaggcttttttgattttattaggtgagattacttggaaggattgtgaaacaaaaattttgccatggttgaaagatcctaatatcactcctgatgatttctggaagctattaaaagaccatttcgatttaaaggactttaagaagaggatcgccacttggatacggaaggcctatccagaaattagattaccgaagaagcattgtttagataagtctatctataaggggtgttgtaagtttttattactttctgagaatgatgtgcaatatcagaggttattacataaggtctgttatttctctggggagtttcctgccatggttttaggtttgggaagtgaagtgcctatggtgttaggactccctaaggttcccaaggatcttacctgggagatgtttatggaaaatatgcctgttcttctgcaaagcaaaagagaggggcattggaaaatctccttggaagacgtagcctctctttaatgaaagaagagtcctcggatgaagcctatgatttcttctgtaggtgttccaggggtattgatatcgttaagacggtcttggaattgtggatacgatgagtagaagtgtttatgagcttgttgggataggggtttaataatatctccagggaggttcaggtggtagaggctttcttctagagctaggtagagcaaggaagggagagcctctgagagttttggtaattctttagctgagctagtatggctatggaattccaaggatggcacagaaagatggggaatgtctttatggttagctctgagtccgtacaaccgtgtgtttagaaataggcatcttcggatgagcacaggagcacggtctatccataagtttgagggggtttctttttgtggatggaagtttttccatactaaagaccagtttgtttttgtgccgtgactgtcgtaggggaatatggtgaagtttgccccatggataatgagctcggagatttccaactgtttcgttagtagcatagatatggaagaaaatcgtacatctgcgtactcgatttcggcggcgtaaggaaagcgttcagaagctagagggttatgaatgcagatatgacggattttaattccagaagttcttatggagactcttcctacagtgacttgggtgtggaggcggttagatagccattgctcaacgatactttctttgcgcatccagaaatatccaacgatgcagcaccctataagaaatagattttttagcagtttaaacatataggcagaggagttttatatcttaataattaagatagattaagaaatgaatattcccaaagaaaaaggtctcttttctttagttagaaaagagacctcatggaaaattgttaatactagcttaagagactagtagtccattcctgcgcttggcatcgctggagctgaagaagatttctcttctgggatatcagcgattaaggcttctgttgtgaggagtaatcctgcgatagaagctgcgctttctagagctgagcgagtcactttagttggatctaaaattcctgcgtcaatcatatctgtataagcgtcacgtaaagcatcatagccttcatttgcagatcttgctagaacttgctgacaaatgatagcgccttctttacctgcgttacttgcaatttgctttaatggagctgttaatgcttttagaataatacgagtaccaatagcttcgtcttcgtttgctagcataggaaggaaagcttctagtgtagggatacagcgaactaaggcagttccaccaccagggaggattccttcttcgacagctgcaatggttgcgtgttgtgcatcatctactctgtcttttttctctttcatctctatttcggtagcagctcctacgcggattacggcgacaccaccggagagtttagctaaacgctcttggagtttttctttgtcgtaatctgaagtgctatcttcgatttgttttttaatattgtcgcatcgagcttggatatcaggtttgtttcctaagccttcgacgattgtggtatcttctttagttacgataactttcttagcttttcctaacattgctagagttgtattctctagtttcatgccaagttcttcgctaactagttggccaccagtaaggatagcgatgtcttctaacatagcttttcttctgtcaccgaaaccaggagctttcactgcacagactctgaatcctgcacggagtctattgactactagagttgctaaagcttctccttcaatttcttctgcaatgattaaaagagggcgtccagattctgctacttgttgtaaaactggaaggaagtctttaattccagagatttttttatcgtagattagaatcagagcgtcttctaaaacgcattcttgagtttctggatttgtggagaagtagctggagaggtatccacggttgaagttcattccttctacaacgtcgagaacagtttcgaagcctttagcttcttcaacagtaatggatccgtttttaccaactttttccatagcttctgcaataagatttccgatttcggaatcattatttgctgagatagtagctacttgagcgatttctttgtgatgttgtacaggtttactaatttttttgagttcatcaacaacaacttttacggctttgtcgatacctctttttaggtccataggattggcaccggcagtgacatttcttagaccttcgctatagattgcttctgcaagaacagttgctgttgtagttccgtcgcctgctttgtcagcagttttgctggcgacttcttttaccatctgagcgcccatgttttcatgtttgtcttcgagctcgatttctttagctacagtaacaccatctttagtcacttggggagagccaaagctcttatctataactacgtgacgtcctttaggacctagagtaacttttactgcttctgcaagagtttttacccctttatgtattttttttctggcttcttcattatatttaatatttttcgctgccatcgttgttctccttaactttctataatctgcaaactagtattttattttaggacggccatgatttcactggactgtagaatgacatactcttcgtcatcgattgtgatttcttgacctgcatacttatccattaaaatgatatcgccaacttgaacttcgaaaggaagtagagtaccgtcatcagttcgtttgcctgtgcctaaaacaaggacctcagcacgatcttgtttcttttttgctgtatcgggtaagatgattcctccacgagcagtggcttcttcttcttccctttttaccaagattctatcgcccaaaggtttaattcggagggtcgttgcttgatcagacatttatatgctccttatgttttacgttctaagagactttgctatttctgcaatcacgataacaaagcgtttttttttgtgcaataattttagcactcaataattttaagtgctaaaaactcaatcttctgaaagcaaggaagagagtaggtctatctttttcgtaatgaatgcaaaggctttatctaatggagcagaggtggtcatatccaatcccgatttctttaatatattgagtgggaagtcagaccttccgcttttcaaaaattttaaataaagttcgagagcccctggttcttgtgtaagaattttttcagcaaaggagagggcagctatgatacctgtcgcatattgataaacatagaaattatagtagaagtgagggattctagcccattctaatgcagatagggaatccgaggttacaacacctccgtagaattctttttgtaaattaccgtaagttgcggagaggaactcttcagtaagaggagttccttgttctgctgcagaatgaatttcgtattcgaaggcagcgaaaaaggtttgacggaacagagtcgcaaatatggtgtctagagttttagtgataattacgattttgtcttctttactttgatctgatttgctgagagcttccatgaggagcatctcattgaatgttgaggcaatttcagcaagaaacagagggtattgggcatcatgatagggctgtgcttctctactgaagtaggagtgcatgctatgtccagcttcatgggcaatgacggaaacgtcatagagtgtattcgtgtagtttagaagaatataaggagcgctatcatagcatcctgaggagtaggctcccgaacgcttgtgcttattttcgtatctgtctacccaacgatttgaaagaagaccatttcttagaatttcaacataatgagtccctaagggaaggaggcttttgcaaactaggtcaacgccttcttcataactataattcttacttgtagtttgggaaataggagcataaacatcataaaagtggaattcttttagatttagagcttctttttttaggttaaaataccgattgataagagaagtgtgtttctttgtttcgtttataagattgatataaacagttgtagggatgttatgttggaatagggatgcctctaggcacgaagggtaatttcttgctttggcttcaaagagatgcgcttggactttcccattgagaagattcgcgaaggtgttacggtaatcatagtaacgttggaattgagctaagtaggcagtacggcgcaattcctgatctggggattgcatatacagcgaagccagggcatgggatagcggatgttcttctccgttcgaatctttagctataccaaaaggaatttctgcatcgcttaaggaagagaaagctttatttgagacattaagggctgcaaacgaggaggctaagatcttttcttcgtttgctgttcctgtgtggggagaaagacggaaaattttttctaggtaaaatctatagggagcgagcactgagctggatagcaaggcagcgactttttcttcagaaagagcaattaaagctggttggatccaagaaatttcctgagaaaagagagtgtagagatagacaatggattggtagtcgctttccccttcgggatttgtaatatcttgatcgtggatgaggtgagcgtatatgtagagttggtctaattttcgttctacagagaatttttttgataaaagttcgagtaaagattcggggttatcgatttgataatgagagggagagaattcgggccatatgggagaacgatcttttccagagctacaaagatcgaaatcttttttccactcctctctatttgcgtacatgagagttgtgtcccaacaatgctttggatctacttgagttcttgttgggagtgcttcggttttcagttcagtagtcatgagggaaggaactcctttttaagagtcaggatgaatgagaaagctcattataagacaatctttaagaaaaagccaagaacaaatcttggtttaaagattagaaggggttggccgtatctataaaggttgtggaaataggaaattcgctttttagatgctctgcaagagattttggacctactttttctgtggctgtatgtccaaatgctaggaagttgatattgctttctagagctgtcgaccatgcaggttcatcaaaatttcctgtgatgaagcaatcgacttgggacgtggctgccgaagagagttctctataagctcctcctgagatcagagctgctgaggagactctagaggggccgcccaaggcagatccttttaggggagcttggtaatattgagataacaggtcaatgaaagaatctatatcgataggagagaaagagccttgcactcctaaataagggagggaagaaccaaagggcttcaagtcatgccaatttagatccagggcaactctccagttatttcctaaggtagggtgagcatccaaaggaaggtggtaggcaatgagttggatattgtgttctattagtaattggatgcgcttatggatcatgccggtaataggatagggcatacctttccaaaaaattccgtggtgtacaatgagaacgtttgcttcggccgcaacagcttgttttatggtttctagatctgcggtaactgcaacagcgattttctttaccggagtttggggatctccaacttgaagtccgttgggtccataatcctgaaatatttttgatgagagaagagtctcaagatgagaaaggagatccgcaacattcatagaacagacttatttaaaaaatagcattagtacacaagtgcccattattgtaaaggttttgttataaaaacaagtaagtattcttagctcatcaaactattctatatgtaagatattagctagttccatgtttagtaattataaatgcatttagagtctttctgtacttttagaattttacatggcttgatgttttcctttagaaatcttccaaaaaaatgggggttgtaattcggcgtatctatctgtggtagagaggattacatttcatattctataaacttcggcagtattttagagtgttagtatttggaatgttttagtttcttaggggaaaccatccgcagatgagattttttccaacgtattaagttttatcatctctatctaattttcagaaagagtatgaagatgagccctggcatgtgaaaagcagagactattagaaaaatctttgagccgaagagtcaaagattttaatcaggctatcgataatgatgttctgtgcgtaagttaggttttcttcggtatgtgcggagctaatgaagtttgcttcgaggggagatggagaaaggtagactccattatcaaatacttcagagtagaaggtttgaaatttctctacatcggaattttttgcttcatcaaaatttgtgggtgcagattctgtaaaaaagaggctgaacatcgttccctgatgtactagagatactgggaatccttgagatcggatttcctcttcaattggagaataaaagagagcctctaattggctgagatggtcatagaatccttcggattggcataattgaatggcggcgtgtcctgtagccatagcgaggaagttcccagacatggtacctgcttggaatatggtgccttcgggcatgaggtgatcgagaattgagcggtgtcctacaagggctgcagcaggtaggcctcctcctaagatttttccatagatggtaatatcgggggagagattgaaaatatcttgagctccttggaatgccactcgaaatcctgtgacgacttcatccataatagaaagacttccgaagcgtttgcagagttctatgatatcgtctagaaattcggctttgggaaggacgatacccatatttgcacatataggttcaaagataattcctgctacttgaggtcctagagcttccatgacatggtgtaggatttggctattgttataaggcagggatatcaataaagaatgtggagagggcgtgtgtatcaatgaagttaggttgtctatagtttcttcagttgttgagatgcctccaagaagagtatctgcatgaccgtgatatccccctataaatttgataataatagagcggtttgtgattcctcgagcgagacgtactgcagtcattgttgcttccgttcccgaggatacaaaacggattttatgttctttgagtttgagcgaggagaggagcattgttgcaaatagaatttcctcttcagaggttaagccataggaggttccttttagagctgttttttggatagccttgacaattttgggatgactgtggccgtgaattaaagctccccagcctccacaaaaatcaataaactctcgtccgtgagtatctaggaaaatatctccttgtgctgagctcactatagggggtgtgactcctacagaacggcaggcccgaacgggagagttcacgcctcctgggaagacttggcatgcctcttcaaaagtaacggtatgcttttgatttgagcagttcaacatggaatttcttttagtgagtttccacatattttggagaagctgatctttaatggctagaaaaagccgtgagttagtttagcaatagattgtcagggactgtagaaagcgaggcatattttcctccaagatctttaagaactaaagcccagagatcttctggttctgagtaaaagacgtagtctttgttccctggagctagaaaccagtcattgcttaggaattctttttcaagttgtcctgcttgccatccgctatagccaaaacataggttgatttctggcccagattcgctagaggcgatttcttggaggaagggaagatctcctcctaagtagactgatggacaaatttctaacgtttgttcaggaatttcggagcatgaatgaagtaacatcatttggtttgcttgtagggggcctcccatacaaaagcggatattatgattggagactttttcaaaggtaaagatgtcatctgagatttcaaatcccagggttttatttaagatgagaccgaaagaaccattgaggctatgttcacaaagtaggatgacactacgagcaaagactccttggtttatatcaggagaagcgactaacaaagatcctttttctaggcgtgcataaggaattttcataatatctctgagtttattcttcgtaggggactacagcatcaaatactgatttaacacacaagatggggattttatgagttaaggcgagagggatgctatcgctaggacgggcatcgacatcaacgacgtatagaaattcgcgatctttttgttctaaaaagagtcttgtgtagaaaacgttatctttatagtcattaattactacacgtaacacttggatatcgaaacctgaaaagacaaagttcagtagatcatgagcaaaaggtctttgaggagagtgtccttcagtatcagcaccttgaaatgcttgccccatggaaacgtgcccatatatagcgaactttttttcttcagtacctaagatcatgcctgcataattacaaaaactgacaagtttgtaaaaattgagaagtactaagggggtttcttctaggagttctttttctaagctcatacagaatattttttgctgattagaccttggctattgctagaccacacttcgactttctctataacaaacccgacttcaataacaccatgaatttgtattaactttaataaatccttttcaggatttgggtaggagttgggggaaaaaatatcgtaaatgtagttgctgctgtctgtaataaataggtcaccagtatcttgtaggcgccattctccttcatatccaagatggcggatttcttcaataattgctgagcgaccgaatcgactgatttctaaaggaacacgaaattttcctaggactggaaccagtttactttcatcaacaaggataatgctgcgttttgctgctcttaaaagaatcttttctctgaaaatggctccgccaccacctttgatcatccgcaattgagggtcgacttcatcagcaccgtctaccgtaagatctagggaagagaatttttctgggtttaagagggggatggcaagctgctttgctagagcataagaattttgagaagaagctatagcatgaactgctaaggactctgtttgaattctatgggcgagtgcaaagataaattccttagctgtagatccactgcctaagccaagaatcatgcctgaagttacttgtgtagcagcctcatgggccaggcattttttctcatgaagatgaagatctttttccacagcgctactactatgttacaaaatattcccacagcttatgcaaagggattcttccaatactatacaaaaatcgaaaccttttggacgagtctttagggtaatcgattttcagatctttaaatgaaagcgtattgatcctattttctgctataggttttagtgggtaggaacggatcttttgtattgcattgtcatgggatactctagaaatctcgaagtgcgaacaaaaattaagaatggaattcttagtagacaatagttggagtattttgaagtgaaatttttccaaagtccccttcgatttagaataggagtgactttaaaattaagatagaaaacgaactagataacgtacataaagggaagagctggttggatctatagaggttccaaccagctctggtttcattatttccaaacttcttcggaaatttcttttactagagcaactttagcccattgctcttcttctgttaatttatttcctatttcacatgaagcaaaaccacactgtggacttagagagagtctttccaagggcaggtagtctgctgcttgatgtatgcgagcaatgacctcatccttattttcaagtgtaggggttttgctggtaacaagacctaagcagacagttttttctccagaaatgaaggtgagaggagagaagtctccagaacgctcatgatcaaactctaaatagtagccgtctacatttgtttgttcgaataggggctttgcaataaagtcataactaccactagcaaagaattttgagtggtagttcccacggcatacatgtaaattaacgactagatcatcgggacgatctgcaattacaagattattaatcagaagatattgttgaatcagatcttgaagacctttttcatcgataccataccacgaacagactcgagggtctactaaacctccccgagtacagtcatctaattggagatagcggcagccagcatcataaagatcgcgaatgactttacgataacctgcaacaatatcttcaattagctcctgatttgtaggatagaatttacgtgtgacctctatattattagggaagatcatctgctttaaaaactgtgccggtgcaggaagagtttgctttgcagtcgtaaattcatcttctagagcttttacaaatttaaagtgatccacaaatgggtggtgagatacagagatcttgtctgtcagataggtatcatcgatcatagcgcgttctccatcaaagaaaactccttctgtagctctgtggtgacctacgccatgaaaaccccacatgaagtcgtaatgccacgtagctctgcggaattctccatcagtaataaaagaaagacctgctgctttttgttttttgatcaaatcttggatagcgatatcctcaatttgcatgagttgatctagagaaatagagccttctttaaggctttctctagttttttttaaatgctcaggacgcaaaaaactaccgacaacatcaaaatgagatttcagaggtctttttagtgaagtattcatgattgtcctccttcagactagtgaaatggaaagagctaagtagaaaaacgtcgaattttctataggattaaaaataagaataaacaagttataggcgtttctgaaagacagaatcgttacttaatactttccacaatgttctagcatttaagaacataggatatattttgtccaactataactagatcatttaaaaatatttgtaatttagttggaatatataaaatcattagcattaagcaaactgtttttcttttcttagtttttagatgcgaataatttgataatttctcaggtaattaaaaatcttttaattgttttttctgtttatgtttgacaagcacaaggtggatgccactctatagtcacgatctttaagtccttgatttgtgaagaaattggtccttaggagttgccgctttcttcagacagttcaagagatcacttcctaatgtatttttagaaaggggaaagagatcctcttaggttagacgtttaggtttggtagtatttcgatagggtttgataaagttgcctcttctacattctcagaggaaagtttatagattttttattattcctatgtaataagaaaaacctttttaaaaagtgcttggggtgaattttatggagaaattttccgatgctgtctctgaagctttagagaaggctttcgaacttgctaaatcttcgaaacatacctatgtcacagaaaatcacctattactggctttattagaaaatacagagtctctcttttatttggtaattaaggacattcatgggaaccctggtttgctcaatacggcagttaaagatgcgctctcacgagagccgactgtagttgaaggagaggtggatcctaaaccttctccgggtttacaaacccttcttagggatgccaaacaagaggcaaagacattaggagatgaatacatttctggagatcatctgctgcttgctttttggagttcaaacaaagagccttttaattcttggaagcaaacaacaaaagttagttttaaagatcttaagaatctgattactaaaatacgacgaggaaatcgtatggattcgccaagcgctgaaagtaattttcagggtttagaaaagtattgtaaaaatttaacagcattagctcgtgaaggtaaactggatcctgtgatcggtagagatgaagaaattcgtagaaccatccaagtgctttcccgtagaactaaaaataaccctatgcttattggtgagccgggtgtagggaaaactgctatagcagaaggattagctcttaggcttatccagggtgatgttcctgaatctctcaaaggtaaacagctttatgtcttagatatgggagctttgattgcaggagctaagtatcgaggtgagtttgaagaaagactaaagagtgttttaaaagatgtagaatctggagatggcgagcacattatctttattgatgaggtgcatactcttgttggagcaggagctactgatggagctatggatgctgcgaatcttttaaagcctgcattagcaagagggacgctacactgtattggcgcgacgactttgaatgagtatcagaagtatattgaaaaagatgctgctttggaacgtcgatttcagcctatttttgtgacagagccttctttggaggatgctgtctttattcttcgtggactaagagaaaaatatgaaattttccatggagtcaggattacagagggggctttgaatgccgcagtcctactttcctatcgttatatcccagatcgctttcttccagataaggctatcgatttgatagatgaagcggcaagtttaattcgcatgcaaattggtagtcttcctcttcctattgatgaaaaggagagagagcttgctgctttgatcgttaagcaagaggctataaaacgcgagcaatctccttcctatcaagaagaggcggatgctatgcagaagtctatagatgctttgagagaggaattagcatctctacgtttgggttgggatgaagagaagaagttgatttcggggctcaaggaaaaaaagaattccttggaaagtatgaaattttctgaagaggaggcggagcgtgttgcagactataatcgtgtagctgagcttcggtatagtttaattccccaacttgaagaagaaatcaaacaggatgaagcctctttaaatcaaagagataaccgtctccttcaagaagaagttgacgagcgattgattgcgcaagtggtagctaattggacagggattcctgtgcaaaaaatgctagaaggggaagctgagaaactgttaattcttgaagaatccttagaagaacgtgtggtaggacagccttttgcagtctctgcggttagtgattctattcgtgctgcacgtgtaggtttaaatgatcctcaacgtcccttaggagtctttttatttttagggccaacaggggtaggaaaaaccgagcttgcaaaagctcttgcagatcttcttttcaataaagaggaagctatggtccgcttcgatatgtcagagtatatggaaaagcattccatttccaagcttataggatcttctccagggtatgtgggttatgaggaaggtgggagtctttctgaggctcttcgacgacgtccctattcagtagttctctttgatgagatagagaaagcagataaggaagttctaaatatccttttacaggtttttgatgatgggattcttacggatgggaaaaaacgcaaagtaaattgtaaaaatgccttgtttatcatgacatcaaatataggttctccagaacttgcagattattgttcaaaaaaaggaagtgagcttacgaaagaagcgattctttctgtagtctctccagtattgaaaagatacttgagccctgaatttatgaaccgaattgatgagatacttccttttgttccattaacgaaagaagatatcgtgaaaatagttggcattcaaatgcgaaggattgcccagagattaaaggcacggcggatcaatttatcttgggatgattctgtaatattatttcttagtgaacagggttatgacagtgctttcggagcccgccctttaaaacgtttgatccaacaaaaagttgtgatcttgctttctaaggctttgcttaaaggagatattaaacctgatacatcgattgagttgacgatggcaaaagaggtgctcgtatttaaaaaagtggaaactccttcttagagagttttctatgggtgcggaattttagatactaggaaaagccctctttgttaagagaatggataggtttttagattctatgtcttcttgctacgctttcttgtttcccgggatcataaaaaaactaggacgataaagtgtgtgtaggattagaattgtgcggcaagcttcatttggctaaacaagagcagtcacagaaatttaagaagtcctatgtttaagagctttatagtaaggtatatgtttgtaggtggccttgtttcattcttgcttcctatccccgacttggaatgtgcgaataatgtaacaaaaacttatgataagaaagcttctgttatatccagagatcttaagctacaggaagactgccagaagttttggaatcttgatccgtataaactagaaagtctttgtgcttatcaagtgctttaccatgatgactatagttccaagagaatacgagagctttttcctcaaatccaaaaagacgaagtccccatatttgcaacaatgattcttactttagggaaagtagaccgtggcttttctcctgaagaaatttcattgatccaaaaactttcttacccaggcctctcattggcttctttgagagggtctacagaaatagacccgaatacagatttggctcgtgctttagtagtgtcggagttttctggagatttagggaagaaccgagctgactactatagcaattgccttgatattttggcgttgcgtattcatgcagaacgtcaaaggtatttagatcagtctccttgtgttcctggaacctccgagtttcataaggcaactatagaagctattaatacgatactcttctatgaagaagcagttcgttatccttcgaagaaagaaatgttttctgatgaattttcttttctttcttcagttacagatagaaaattcggcgtatgtttaggggtctcttctctttatttctctttgtcacagcgcttagatttacctttagaggctgtgacgcctcctgggcatatctacttacgttatcagggtggtgaggtgaacattgagactacagctggagggcgccatcttcctacagcaagttactgtgattgtctagatttagaagaccttcaggtgcgtactcctgaagaaatgatagggcttacttttatgaaccagggctcttttgctctgcagaagaaaaagtataaggaagcggaagaggcttataaaaaggctcaagagtatttgggagacgaggaactacaagagcttttggggtttgttcaaatcctaggaggaaagaaaaaagaggggaaatctttgattggtaaaagtcctcgcgcttcccagaaaggatcggtggcttatgactaccttaaaggtagaatcaacattccaacactagctcttttattttcttatccaggatccaattatgaagagatagcttcttatgaagaagaactcaaaaaggctatgaaaagctcgatgccatgttgtgaaggacagcgtcgtcttgcttcagtagcatttcatttggggaagacagcggaggcggttgctcttttagaaaaatgcgttgaggatatccctaatgatctttctcttcatttaaggttatgtaaaatcctatgtgatcgacatgagtatacaaaggctttgaaatacttcataattgcggaaagacttatggaggatcagggatttcttaaaaaagacaatcgttcgttcgctttattttatgaggtgaaaaaaatcatatccaaagtggctcctcaaaaagctaacaccttgcttttaatggagtctgaaagataacttgatcagttctttctgtattgctcttatttataacatgttataacattgcaagtgttaatttttaacagatctttatttgttgcaatatttttttaaataagaattgagctattttttagcctcatattgcagatgtcatgaaagatttgaatcaaagtaagtcttgctttccaagctttggtaggattaaagtgtttgagatgaattcgcattttttaaattattgttggaattagtatgagcagttcggaagttgttttccagacagttcatggccttggctttggtggattgtcttcaaaaagtgttgtcccttttaagaaaagtctttcggatgcgccccgtgttgtgtgctcgattttagttttgactctggggttgggagcgcttgtttgtggtattgccattacttgttggtgtgtcccgggagttattttaatggggggaatttgcgctatagttttaggtgcaatttctttagctttaagtctattttggttgtggggtttattttctaattgttgtggttctaagagagttttaccgggtgagggattgctacgggataagcttttagatggtggattttcaagagcggcaccttcaggaatgggacttccgggtgatggatctccaagagcgtcaacgccatcttgcctagaggaacttcaagcagagatacaggcagttactcaagctatcgatcagatgtcagatgattgactctaaagcgtagaggtacttaagggagaggctttgctaatcagtaaagaaactttaatacaagtaagatctaagttgaataacttaaaaagataatgaataaaaacaaaatagcatgggggaccaatggctgttcaatctataaaagaagccgtaacatcagccgcaacatcagtaggatgtgtaaactgttctagagaggctataccagcatttaatacagaggagagagcaacgagtattgctagatctgttatagcagctatcattgctgttgtagctatctccttactcggactaggtcttgtagttcttgctggttgctgtcctttaggaatggctgcgggtgctataacaatgctgctgggtgtagcattattagcttgggcaatactgattactttgagactgcttaatatacctaaggctgaaataccgagtccagggaacaacggtgagcctaatgaaagaaattcagcaactcctcctctagagggtggtgttgcaggagaagccggtcgcggcggggggtcacctttaacccaacttgatctcaattcaggggcgggaagttagattttttatctaacctactaagttagtattttaactgtaggtttttccttccgttgttttaaaagaacctcaagaataactagaggttcttgtttgtttattgcaatcttcgtttttgctatctatagttaacttatataaatataaggcaaatggtggagagttagctctatggaaagtgagaaagatataggagctaagtttttaggtgactataggattctctatcgcaaggggcagagcctatggagcgaagatcttttagccgaacatcgatttataaaaaaacgttaccttattcgattacttcttcctgatctaggaagttctcaaccattcatggaagcttttcatgatgttgttgttaaactagcaaaattaaaccatccaggcatcctcagtatagaaaatgtttctgaatctgagggaagatgtttcttggtaacacaagagcaagacatccccatcctttcactaacgcaatatttaaaaagtattccccgcaaacttacagagctagaaattgtagatattgtaagccaactcgcttctcttttagattatgtgcattcagaaggactggctcaagaagagtggaatcttgattctgtctatattcatattttgaatggtgttcctaaagtcatactccctgatctggggtttgcttcattgataaaagaacgtattttggacgggtttatttcagatgaggagaatcgagaatctaaaataaaagaaagggtactacttcacacttcagaaggaaaacaaggtagagaagatacgtatgcttttggtgctatcacctattatttactttttggttttcttcctcaaggcattttccctatgccttcgaaagttttttctgattttatctatgattgggattttttaattagctcttgtttaagttgttttatggaagaaagggcaaaagaacttttccccttaataagaaaaaaaactttaggagaagagctgcaaaatgttgtcactaactgtatagaaagctctttaagggaagtgccagatcctttggaatcttctcagaatcttcctcaagcggtccttaaagtaggggaaacgaaggtaagtcaccagcagaaggaatctgcggaacatttagaatttgtgttagtggaagcatgctccatagatgaagccatggataccgctatagaatccgaaagtagttctggagttgaggaggaagggtattccctagctctacagtctttattagttcgggaaccagtagtgagtcgttatgtagaagctgagaaagaagaacccaaaccgcaacccatacttacagaaatggttttaatagagggaggagaattctcccgaggaagtgtcgaagggcaacgtgatgagcttcctgtacataaggtaattttacatagctttttcttagatgttcatcctgtgacgaacgaacagtttattcgttatttagaatgttgtggtagtgaacaggataagtattataatgagttaatccgattgcgagattctcgtatacagcgtcgttcgggtaggcttgttatagagccaggttatgctaagcaccctgtcgttggggttacttggtatggagcctcagggtatgcagaatggataggaaaacgcctgcctacagaagctgaatgggaaatagctgcttctggcggggtggctgcgctacgctatccctgtggggaggaaatcgaaaaaagccgggcaaattttttcactgcggatacgacaacagtcatgagttatccacccaatccttatggcctctatgatatggcagggaatgtctacgagtggtgccaagattggtatgggtatgatttttatgaaatttctgctcaagagccagagagtcctcaaggtcctgctcaaggagtctatcgggtgctaagagggggatgttggaagagcttaaaagatgatcttcgctgtgctcatcgccatcgtaataatcctggggctgtaaatagtacgtatggttttaggtgcgctaaaaatatcaattaagagaggttcatgaaggaagagaattcacaagcacactacttagctttatgtcgtgaattagaagaccatgattattcttattatgtgttgcatcgtcctagaatctctgattatgaatatgacatgaaattacggaagcttcttgaaatagagagaagtcatcccgaatggaaagtcttatggtctccctcaacacgtctcggagatcgtccctctggaactttttctgtggtttcccataaggaaccgatgctttccattgccaatagctattctaaagaagaactaagtgagtttttttctagggtagaaaaatccctaggtacaagtccacgttatacagtagaacttaaaatcgatgggattgcagtagcaatacgttatgaagatcgtgtgttggttcaagcactcagccgaggaaatggaaagcagggagaggatatcacatcgaatattcgaacaatacgctccttgcctttaagacttccagaagatgctccagagtttattgaagtacgtggcgaggtcttcttctcttattctacgtttcaaattatcaatgagaagcagcaacaattagagaaaactatttttgccaacccgagaaatgctgcaggaggtaccttaaagttactttctcctcaagaagtcgcaaaacgtaaattagaaatttctatctataatctcattgctccaggagataacgattctcattatgaaaatcttcagcgctgccttgaatggggatttcctgtatctggtaaaccaagattgtgctctaccccagaggaagtgatctcagttttaaagactatagaaactgagagagcttccttgcctatggaaatcgatggtgctgtcatcaaggtagacagtttggcaagtcagagagttcttggagccacagggaaacactatagatgggccttagcttataaatatgccccagaggaagcagagacccttcttgaggatattctagttcaagtaggaagaacgggagttctgactcctgtagctaaactcactcctgtactgttgtcagggtctttagtatctagagcgtctctatacaatgaagatgagattcatagaaaagacatccgtattggtgataccgtttgtgttgctaaaggtggagaggtgattccaaaagtagttcgggtatgcagagaaaaacgtcctgaaggttctgaagtttggaatatgcctgaattctgccctgtctgccatagtcacgtagttcgggaagaagatagagtttctgtgcgttgtgtcaatcctgagtgtgttgcaggagctattgaaaaaattcgtttttttgttggtcggggagctttaaatatcgatcatttaggggtgaaggtaatcacaaagctgtttgaattagggttagtgcacacgtgtgcggacctatttcagctgactactgaagatttaatgcaaattcccgggatacgggaacgctctgcaagaaatattctagagagtatcgagcaagctaaacatgtggatctagatcgttttcttgttgctctggggattcctctcattggaattggtgttgctactgtactagctggccacttcgagactttagatcgggtaatttccgcgacttttgaagaacttctttcactagagggtattggagagaaggtggctcatgctattgctgagtatttttcagactctacgcatcttaacgaaatcaagaaaatgcaggatttaggagtgtgtatatctccttatcataaatcaggatctacgtgttttggcaaggcttttgtgatcacagggacgttagagggaatgtctcggttagatgcagaaactgctatccggaattgtgggggtaaggtaggctcctctgtctcgaaacagaccgattacgtagttatggggaataacccaggatctaaattagagaaggctaggaaattgggagtctctatcttagatcaagaagcctttacaaatctaattcatttagaataatttattttaaaattttcttaatacattaattcttatttgtaaaagttttatttaaattatttattataaattcttttacagctataattgtccgtattttataagtttttttgttcttttgggagtaaacatggcttcttcttcaaacaattcgactaaacaggacggcataccatcttgggtaaacccaaatgtccagtggaatcgagcgtcccaggtgggtgatcaagaagcgaattctctaactccagaggctcaaacttcacgtagctggttttccgatcgcaagcattttcttgaagtcttagacgttagtctagaggagatggagaacaatgaccttaagaaatactctagatataagacgattatcctgattgccacgctggtcactgttgcgattacctgtatcgttcctatctctatggtgtttggtatcccgatgtgggtgccctgtcttattttatttggagcgggtctttcttcggcttttctttctcatcgtcttcaatctaagtgcaaggagatccatttaagataccgagcgtaccagatttatcgccagcagctgttgagtcagtaccctgacttgagaaagtctactctctataaatatagtattacccatgtcaaaccgaaaaagggatttgttggtaaactcgtagaaaatttgcgccctgatttgcataaaaataaggacgatgggggtgctgctgcagactccagattagattttgcgggatatggagtaaagcattatcagacggatgctctacttggagtttcaggtgttaatagtgtagaatggcaacgtcttgcctctctgattatgagtgttaagaacgacattttaaatgatgtgggaagcagagagcccattgataaagcgcaaaggtctgctttagtagtcagtggtaaggatattggaggggagattcagcctggaggtattttagatatttccagagatattctagcgatctgtggctacggtatgaatgtaggtgttgaggcgaagaaagctatagaccagtataagaagtggtatctcaatagtagtacatttattgcttggaatccgcagcttcctgctattgcccagtcctatttactagaacaacaacgacatctagattatgctgctaagattttccaagatctttccgcattgacgacagcccatggtacagggcaggctcttgaagatttagatagtttgctttgttattatgatcagttaattgaatctaaaggtgtcggtgaaaagataatagcatcgattcaccagaagcatctcgacttagcaatgcaagattcctgcgatcaggaacatttaaagaaatggtcgaatctataccacgtgttttcaattactattaaagaattcactgaaggtaagctagaacaaaatgaggtagtatctagaatacaaaggcttcgaggtaagttagaaaaaagtaaatgcagcattcttggaaattgtcgaaccaacgcagaatatgcaacaaagtctgaaaaaaaactcgcagattatttgctgcagattggggatagagaacctttccttactggaatgcataaggcgatagccaccggaaaagctattcaaggaaaagtggaaggagtcatttcacaacatcctgaaaagcaaattatgatgcttcggtgttctatagagagactcgaagggatgttgcgtcgagaggattggggagcaatcctacaaaaaaacgaagacgaagtccttgcattgaagagtacaatggaagctcagcttcaaggatttaaggaccttgtaggtacctgggaaggaaaatatcaggaatttaagaaaaacaagctttccaaagttttagtttacgacttcacaaaatcctattctaaccttctaaatcgtttggaggtactccatgccgagagctccacggatgatttggtattacatgtcgatagaatgtcggaagatctgaagaaaacaatcgaggagattgacggcaatttatttcaggtaactcctgaagagctctctttgttagctcgggaatatcagggactcatgaatgaacttcctctgatcgttcaagaggggaatcggctccaagaagcaatctctagtgaaggggtttctcaaggattgatgttgttgaactctttattgaatagagatgaaaaaataaataaaaacatagaaagcagtaggaaaaacttagtagctatcgcgaaacaagcacgtagcgatgcgagaaatatagacagtcagggattggctcctttgatccaaaggaatagagctagcctggacaacattctccagaatatgtatttgtttaacggcagtatacgtaatatccatgctctagatacggaaacgttagtggcaacttcctctaatatgttttctgcgatgcataccttcgactggaatatctatacgaatttgcttgatgttttagaaatccaaagcaaaccagctcctgcccctatggagaatcctgaccttcctggagctcttcctgaagaggtccaggatgcggttgctgaagatgtttctgggactcacaggctacatcaccaggtgttaaagagacgctgtgctgacttaaaaaatatgatcagtcaattgcagaagtcgataaacaaatggggaatggctaaggccattgtcctgggaattgttgcggtgctcttctgtgttcttagtgctatttttattggtcagaacattttatccttactcattctctcttgtgtagggttacttttgactcaggtatgtcctttaatctttgatcgtatatctaagagcaaggagtttgagaagcaagtgcttgagacagcgcagtccttgattcctgccactaagattcttccctcagaattcaataataaggatcttaatcgtttagctaagctccaggataatttaaatcttgagggttttggtcctacatgggcgcgcaatattgtgagtgatctagagggcattccgactaaagaaaagagcttgaaggatcttactaaagagttccgtaaggattctaaaaacttaaataagcgtataaaaagacgtttcaaggaggggttaggacaagaagcgcctgtggttcgtcctactatcccccaagatattcgtggagctgaggtttttgcagagttacatcgcgagttagagcaccttcaaaagcaaaaagaagagattagtattcggggagatgctctggttcaagagcgcatgggtctgtgcttagaaaagtctaagtacgacaatgaaaaggctcatgctgccgctatgactaagaaggttggaaaattacaaaacatagataggcttcaaaaaaataatgaaacgtatgtaaggattcagaatttttttagaactttgattcaagagaaattagggcgtgacacagtccaagagatagacgtagtcaaagaggctaaggaattacacgaattagcagcaatcatttacggcaataccagtgggaaatctcagaagcaaagagcaaaaaagcagtttaaagagaatgttttacacatagcagggaagggtcaattagaacttttagaggcttacttgaatgtgacagcttctcaagggctctgtcgccatcaaatgcaggcttcatttagagaaagaatcctgctaaatcccgatggagcaaaacatggagaagccgagaggacgcttgcttctagggaagaaatgttgaaaactctagggctttcttatttgacgccttttgtaagattttcttctccagaaagtacgcagtctggatataaccaaattctgaaagtccgtgagcagctcttcgatattgagcagaggcttcagaatcaggagactgtgagtcccgaggactatgcggctgtacaagctgctttagcagcttatgtccgcaagcatgaatctcttatagtttctacttatggattgggtgctcaagaaggacaaacgagttctaaagtgaccactttaatgcgagatttgcatgctgtagaagagcttgttgagatgggtgtcgaaacgtatcgattgaatcgcagcgatcagattctgcatcgcgtgcattctgttttacacagccatctgcgagattgcgattcttcaggaaatggaattattgatgtagttaagaaattgtttgagcttctgaacaataacgggaacaatcctaatgatcccgaatgccaaaagtatatgcagatacttttagatgcaccagtcagtctattgtatggtgcatttaaaagtttcaaaaacgaatttttacttaatttcacggaattgaatattgctaattcaacaaaagctgctgaggaagaagctaaaaggtatgttgaagagaaaggtagaggttttgagacttattgggaggaggctaagcaacgattggaagcaattgctgctgagttggacgacttaaggaatcaagagactctattggaacaagaaattcgtttggcgaatttaaagataagtatctttagtgacttaaatttaagagagaaggtttcagtagaaaaagcagctttagaagaagaaatccaaggaatacaagagcaatatgcagagatgcaggggattgaagatctagagttaaaacaaaaattcgaagatttgcaaaagaaacttgaagctctagaagaaagattgttgcaaataggtcgaaggatagattcctctgtagacaagcagaaagaactgttgggtctcttgggtagagaagaggctgcttagagaaatcattgcgtttgcagatctcattgatggtcagagattctttttctcatcaactgcaatgaaaaccatagaggactaggaaaggctctctatggttttttttcacaatttccactaaatgcccacaaacgataggtagaccttccaataggatagcgtcctaaaaaggagttagctggtcttttcgctggcaaaaattctaagtagatatgagatcagctcgtgcagcttaaaggtatgtgttctatatccgatataacgatcggggcggataataaatagcgaatttggatttgcgtgatagaggttaaggattcgaggttccttaacattgcaaatctctatccattcgccatattcttcttgtagagcttcctttaagtcggggatatctttaaaaaagataagaaggtgcttactactttttaaaggatctaagaggaaagaaccgttttctaggcgagcatctatagctctcattcctggaccaggaccatggatttccttatcttgaggagacattttgataatatcgctagaacggtatttcagtgcttggtgaggggggtagtaatactcttctcctgtagtattaaactttcgacatccctttaaaaagtagtacatcaaagcaggtgtatagaagcgagaaaatgggagtttcttcgcgcgcttttccgtagtaggactaatataaggtaggatattgccatcttcctgttcttttgtaatcaccaaatgttttaatgcagcttttttcaatacaggaagtagcttccaagcgagattaaaggctgcgtgaatattggtattaataccgttgagataagaaagaagcagagtattagagaggctacctaaaaataatacatttccatgttcaggagggaatgcgtggtgacttgtttttatatggaaattttcatcagagatgacgagattgtaagtataaagtagcttctgtttaagtttcggtgatatggaatgcgttccttggggtagacagagctgtttcgttttttcctggggattatagaaaacgaaatttaagaagttctttgtgatgggaagaagatggatatgatcttcttcaaagggctcgccctcatcgcaattgataaaaataacttctcgatttattctacgtgctctcagctggcttttgacaagatccctgatgtctaggttgttgtcagcctcacaggctataatccactttggattgtagatctcacgattttcaaaattttgtgatactttagtactttcaataaagatactgttatcaactagagttacggggcgtgtcgaccaatctatgacgcctccgcgttttagaaactcgtcaattaggtgctgttctaaactttgatatgttgttgatagagaaaaaggaactggagagtccgttgcttggctgaacttaaataataaggttctctttttccaatggtaacgcgcaccaaagatcttatggttggcttggataaaatcgcctagcatttcactattgtgaagaagctccaaggaagagcaagacaagattacagggagcttacgacaatctaagaagctaggatcctcaggagaagctctgtggtcgataacttttacagagatcccatgttgtattagcatatttgccaaaatgagacctgtaggattagcacctatgactaaaatgtctgccatacttgccctcggatagtgaaaaagattttcataacattataggataaaatcctaggaggaatcaagaaacgaattccaagagctatgaatataggtgcttccatctagaagttgtatttaaaattgtagtgttctagaaccgttgtaccttgaattaaggtacaactgaaatttaaagtgttcgttggaagtggctcacaatttgatctaagatcatatctaaatcaggagctgtggctaagttgtgtcctgtgttagggtaagagatgaaagtcattcttccgggagctgtgtttttaaatagtgtctgttgtgtcctagaaacaagagtgtcatcaatgccttgttgatgcaaaatatagggttttgtgggtagggaatttgctgtaacgtgatcttggatgcgtatgaggagatcaacatcgccagagcaaacaattataggaggaggaccaaatccaaagtccttcccaacagagataatatctccttcgccgtgtttagagaaattctcatagagctcttttaataagatgcccccatctgcaattggagcccatacactcagggctttgatatttaagtctcttgggttatagattttagccaactcgaaagctatgtggcatcctaaagaaaaacctgaaattcctagacgatatgcattgagatctgggtgttcttggacagtttcaagtatggtttgtgcatcacgtaaataggtctctataggaacttcttcagcaactccttcactatctccacatccggccatgtcgacacgtaaagtggcaattccaactgcagcgaattttcttcctaattttcgataggctccagttaaacctccgaattttgttcctcggaagccgtgaaacaacacgactgtagggaaccctccttccggtgtgggagtgttaggaagatgtaaaacaccaataagattgtgatcgtcacatttgatagtaactgctaaacatacttcttgcttcggacatacttctgtcttgatttgaacgagatcttctggaatttgaggaaatcccggaacacggactggagctgccgaagcccctatagctactgaaaataggcaagaaactaaaaaagcaactttacgcatcttgattaactaattaaaaaaggaacacatatagagtaggggggcgctcctgtttttgtcaatgtcatggaagtttttgaaggaaaaacggacaagactcttgttttttcctctggggagacgtacactaagcctttttaatttttatatatataaaagtttagaatatgcgatatgaccccaacttaatagaaaaaaaatggcaacaattttggaaagaacatcgaagctttcaagcaaatgaagacgaggataaagtaaaatattatgttttagacatgttcccttatccttcaggagcaggtctacatgtaggccaccttattggctatacagcgacagatattgttgcgagatataaaagagcacggggattctcagttcttcatcctatgggctgggatagctttggtttgcccgcagaacaatatgcgattcggacaggaacccatcctaaagtcacgacccagaagaatatcgctaattttaaaaaacagctctccgctatgggattttcgtatgatgaaggacgagaatttgctacgagtgatcccgactattatcattggactcagaaacttttcctttttctttatgatcaaggactcgcctatatggccgacatggcagtgaactactgtccagaacttggtaccgtattatcgaatgaagaagttgaaaatggattctcaatagaagggggatatcctgtagagcggaaaatgcttcgtcagtggattctcaaaatcacagcatatgccgataagttattagaaggtctcgatgccctagattggcccgaaaatgtaaagcagttacagaaaaattggatagggaaatctgaaggggctctcgtaacatttcatttgacgcaagagggcagtctagaagccttcactacccgcctagacactttattaggggtgagtttcttagtgattgctcctgagcacccagatttagattctatagtgagtgaagagcaaagagacgaagtcacagcctatgtacaagagagtctcaggaaaagtgaacgagatcgcattagctctgttaagacaaaaacaggggtctttacaggaaactatgccaagcaccccattacagggaaccttttacctgtttggatttcagattatgtcgtcttaggctatggcacaggcgtagttatgggagtcccagcgcatgacgagagagatcgagagtttgctgaaatgttttctcttccgattcatgaggtgattgatgataacggggtttgtattcatagcaattacaacgacttttgtcttaatggcttgtctgggcaagaagctaaagattatgtaatcaactacctggagatgcgttctctcggaagagctaagactatgtacaggctgcgagactggctcttctctagacagagatattggggagagcctatccccatcattcattttgaagatggaacgcaccgtcctttagaagatgatgagctgcctcttctccctccgaatattgatgactatcgtcccgaaggattcggtcagggtcctttagcgaaggctcaagattgggtgcatatctacgacgagaagacaggtagaccaggatgtagagagacttatactatgccacagtgggcaggctcttgctggtattatcttcgtttctgtgatgcacacaactctcagttgccttggagtaaagaaaaagaaagctattggatgcctgtagatctttacattggaggtgcagaacacgctgttcttcatcttctttactcgagattttggcatcgagtcttctatgacgcgggtcttgtctcaacaccagaaccttttaagaaactgatcaaccagggacttgtgttagcctcttcataccgaattcctggtaagggatacgtaagcatagaagacgttagggaagaaaatggaacgtggatctcaacttgtggagagattgtggaagttagacaagagaaaatgtctaaatcgaaactcaatggtgtggatcctcaggttttgattgaagagtatggtgcagatgccttacgtatgtacgctatgttttcgggacccttggataaaaataaaacctggtccaatgaaggtgttggggggtgccgtcgtttcctaaatcgtttttatgatttggtgacttcgtcagaggttcaagatatagaagaccgtgacgggctggttctcgctcacaaattggtgtttaggattacagaacatattgaaaaaatgtctttgaataccataccgtcttcatttatggaatttctgaacgatttttcaaagcttccagtctattctaaacgtgccttgtctatggctgttcgtgtattggagcctatagctccgcatatcagcgaagagttatgggttatattgggaaacccaccagggattgatcaagcagcatggcctcaaatagacgagagttacctagttgctcaaactgtgacttttgttgttcaggttaatgggaagttacgaggacgtctcgaggtagccaaagaagctcctaaagaagaagttttatctttgtctcgaagtgtagttgcaaagtatctagagaacgctcaaatacgaaaagaaatttatgttcctaataaactagtgaattttgtcctatgatgctacgaggtgtccatcgtatttttaagtgtttctacgatgttgttttagtttgtgcatttgtaattgccttacctaagcttctttataagatgttagtttatggtaagtataagaaatctctagcagttcgttttggtctgaaaaagccgcatgtccctggagaagggcctttggtgtggtttcatggagcatctgtaggggaagttcgtttgcttctacctgtacttgaaaaattttgtgaagaatttccaggttggcgttgtctagtgacttcatgtacagaacttggagtgcaggtggcaagccaagtgtttattcctatgggagccactgtttcaatactgcctttggattttagcataattatcaaatcggtagtcgctaaactgcgtccctcccttgtagtcttttctgaaggggactgctggctaaattttattgaggaagcaaaacgtataggagcaactactctcgtcattaatggtagaatttccatagattcttcaaagcgttttaaatttttaaagcgcctaggtaaaaactatttctctccagtagatggatttttattacaggacgaagtccaaaaacagcgttttctttctttagggatacctgaacataaattgcaggttacagggaatattaagacctatgtagcagcacagacagcactgcacttagaaagggaaacttggagagatcgtttgagattgccaacggactcgaaattagtaatcctaggttctatgcatagaagtgatgcaggaaaatggcttcctgtagtgcagaaattaataaaagagggggtctcagttttatgggtgccaagacacgttgaaaagaccaaggatgttgaagaatctttgcatcggttgcacattccttatgggttgtggagccgcggcgccaatttttcttatgtaccagttgtcgttgttgatgaaattggcttattgaaacaactttatgttgctggtgatttagcatttgttggaggtactttcgatcctaagatcggaggacataatttattagaacctctccaatgtgaagtccctttaatttttggtccacatattacatcgcaatcagagcttgcgcaacgcctgttgctttctggtgcaggactttgtttagacgaaatagagcctataatcgatacagtttctttcttactaaataatcaagaagtgcgtgaggcttatgtacagaagggaaaagtgttcgtaaaagcagaaacagcttcctttgaccgtacatggagagcattaaaaagttatattcccttgtacaaaaatagttaagtttgataaattcatcggcatatcgcgggatagagtagtggtcatctcgttgggctcataacccaaaggtcggaggttcgaatccttctcccgctaattaccattttgcatggcggtatagctcaggtggttagagcagcagaatcataatctgcgtgtcgttggttcaaatccgactaccgctatccatgctagaagacattcattttttaataaaatttaaaaaaatcttcttagccaaaatttcctacctatattttttacataacactttgtttttcaatttggatttatgttttctcgaagaaaataaagatcttcataaccaagtaaatcagacttaaagtacgtcctgatgcctttttcttgattagagaatccgttagaactcgaattgtgtgttttcataaacaattcatgccgcatttcttcaataggaattagagaaatttttaatttttctaagaaaggcactccaaaactcaaggagttttaactaactaaaaaagataaggaaaataaaatatagcagataatactgtatttttgaatagctcttgcttactcatctctaataaacaagtgattctttaacacacctttattggagccttcaaaaaaaagagtaaagccagtggtattggactcacgaagatcacaataaaagaaccctgcaccgagctccttaagcctttctagtagaataaagccacatccgtcaggatgatcagattgtggagttgcagctctataaaaatagaaacagtaccatatagtaaagagattgcctattgtagatggtattccaacaccaccctgagctattggatacttattagggaaaaatgccgtcctaccaagaaaagcgcttcgtccaggttcctcactaagaacaacaatattgtgcatcatatgtctagccagaagcttttgctttccaagctaaaatatttgttgccttcttctttcagaagaatatcttttatcagtttttcttcttcaggatgacctgtaaagtcaaaaggtcgatttttcaagaggagttctgtaggccaatctaacgttaaaagtaattttataaaacttgccttaaggagtttcaactttcataagttgatatttcttaggaagagaatagaagagcggagaaacagttagagccgcttctttcactagcgcaggatttttggcaatgatcagttcttcggctttagtaatttctgtggggataaaaaatactgctcgatccaaatctttattaaacttgttatataagaggtagcgtatcgctagagctatcaagactagaggaaacaggataaaggaaaggatttttaaaattttttctgctgtagaaacaacagccttctcttttttagccaagataagtccggagggtcgaagagaaataatgcgcgtcacagtctctcctcctaaacaaaaataggagttcagctgagccatcaacgaagcttgccaattaggggaagctccaggagaaaattggtatatgttcataagggcttctttataagtgacaaagctaaattataatcatttttgtattaagattaaaaacagaaatctcaagggaaaacagtacaatttagattagatttatccgcctgagcaccatccgaactctaaactttttaggaagtctagaatagagagccatgccctttttaattgtctttgataaatccatgatccttcaacacagatccatagttttcttcccaaactataaggaatcctataggtccatatggacctccattacgcccgtcattttgagcgcctgcttgtggtctatattttaatccaaggtttaagagcctattatggacttcgcagcctgcttgtttaaaatccttttctagtttggggccgttagaatggtagtaataaaaataaatgaaggcccatacagtgggttttttagtttcatgactgaactcgattaagaaagattctctacctccatcaatagtggatgtaggaaagttcaatccggtttcgagcttaaagagttgttctaagagataacgtgccaagattttcttgctttctaaacaaaactcctcgccaggattattcttttcaagtttagcaactgtatcaattatagccttgctttcgggataataggcaaaatcaaaatcctcactcaaatagagtttaggccatggtatagaatctgtatctaagtcctctaagagcaaatctatatttatagagagggtaattttaggaggctaccctttagaagtttggatgtacatactttggtattttgtaggtagggcaaagaaacctgggtggacctctcgagctgctttttcaactaattgaggatttgctgcaagaattagctccagttctttaggcgtgtcttgagggataacgaagcattttctatcgaattttctatgtaagaagtagcggatagccagagcgattaaaatgatcgggaagaagatcagagcaaggatctttataactttttctgctgttgagacctgtactttttcttcagtagctaaagaaaacccagagggagtcatggagaaaatccgagttgcagtttctcctccaaaacaacactaagagtcgagtttactcataagcccagcttgccagttcgggcagatgcctggagaaaaagagtatatgttgctcataaacaatcccttttaaagaattagccatcttattttataaattttctgattctataagtcttagttgagaattttaatttttaatatagatgtttttttaaagcttaagaaatcttaacacaaaagagccgttcctttgcatctagcttagaatattcttataggaatggacaggttgtcagagtagaggcgaatgcgtttgattttcccaaagcagggtcaaaggtcgttgatctataagctcctctttcccgaagtactgtaaagggcctggaaaggcgaatgcgtttgattttcccaaagcagggtcaaaggtcgttgatctataagctcctctttcccgaagtactgtaaagggcctggaaaacggtataaatcttcaaccaaacaagaatcactttgttgaagtaaatgttgaacagcaggggattttgggtctacagaatctgttttaataacaggagtctctgtcccacaacgattttctaagtgcatcatcttatataatggagtggctcccccttgccattcagtataagattgagcaagattattgattgtaatcatataaccagtcttttgtcggaccagaaataacgcagaaatgatccctaaagcgattccataattacaatcaaagttggaagggaatcctgctcgtgcttcataaccaaaaaaatgcgatacagaatggaattccatatggggttttatcttttcgatttccttctttaccattactgcaagcagctcttctgtagcaatttttgaaactctaacatttccatgagaatctcgagctagaagaagttggttcgcaatatccttaggaaacaagtgaaatgtttttaatgtctctggagagagcttggaaagaattttttcaatagaagaatctccattggcgagtaaaacattgagttcatctataagcttgcgtgtatcgaaaatatgctcaatcagtccctctgggattaacacagtactatagttttttccagatttatagcggcgtaccaaacctaaagcaagctgttcactcagttgctttaaagagattttcctagtggcaataagttcgctaattaaagctatattagggagggtctgcaatccgcattctaaagtagtataagaggcctgctgccccataaggcggatgaaatggtggtatttttttgcagaaagagcatctttagcaagattcccaatcatttctgagtacgtgcgacaagaagtatgaaaacctaacgaggtttcaatccaacagttcttaagatcaccatctatagttttagggactccaatcacggatgttttgcagttgtgagcaaggaaatattctgcaagcatcgcagtgtccgtattggaattatttcctcctataatgagtagtccgtctaactttagttgcttgactgtgttgaggatgttttttttctgctcttcagttttaattttttctcggcttgaggagagcatgtcgaaccctcccatgttgtaataatcatagattacggagatatccagatctttatagagcccacgagtaagccctaaaggtcctttgatgaatccaaataagcgagtcttgggattgaatactcgtaaagcatcaaaaagaccaataacgacattatgccccccaggagcttgtcctcctgatagtaaaaccccaatctttaatggttttgatgacgtttcctgttcagtataaatagaaacttcagggatccgacatagattgggaatgtgtttttgcaactctggagggggagaagggggagacgaagtttcttggatatgtttcgaacgtatcgtttctaataaagtaagaatctcagggcggtagcgaaggcgttggatttcaaaataacttttatttaacgagagaagttccacagtttattccccagaagttaattctctttttaaccattgcgtgagatccgaaagagccgaagattcggcaaaaggaaacgcgtgatcgacatcgggataagtaagaatagtaattggtttgtcttgatttgcaaatgcttcggtaaacagtgttctgtggttgatagaaaccagaagatcttgttcaccttgcatataaagaattggagggagattgcgagcactaggcataagctctttcacaatatctatttttaagaattgcgtataaaaatcaggatttaaagtcatcccagcataagtaatggcgcctttttgactcattgtgatcacttcaggagcatttttttgtgcttccgcagccattaattctcctgaaattgtaggcgcccatacagctaaggctttgattttattaaaaaaaggaagagtctgaagagcaagagttcctccgagtgatgaaccaaaaatagcgagcctttcttggtctatatgaagtagggaatgcgtatattcaatgatttcacgaatgttttgcttataattttcaagagaaaaatccataagctcaccctcacagtctccatgaccaaggagatctactcttagagctgcgatacctaaccgagtgagttcctgagctagcctgacatgagagcgtttcgaaccggttttatctgaagctaaaccatggagaaggatcactataggatagggaggattataatggagaggagtatgtagaaggccaaaagttgtaaaattattcagtagggtcagtgaaaacatggtgcgctgctcatgcttttccaataccacgcctgtaatcaaaagaggctcctgctttctggatgtgcttgacctatgtcaatgtagtttctaaagaaaaattagtcgagaaaattcgttgcatggaatgcctctaactaaagttctcaaaaacagccatcaaaaatcgtgtaaaatagtatcagaacaatccctggatgaatagtttacaggaatgatttaaacctccttattgggttgataggaatcttcccaatagatacgaatcccttgaaaaccttgaaaattaggattgtctggtccttgagaggggcaaattggaaacctaactcctaactcttgtaattgctctaagatctcaaatcctcctcctcgatcttcatctagaggaccttgtctgaaaaagacttgcggccatattgtaggattttgtggagtaaaatgagaatagatataacgaacactagggaatagagtcagtcttccagatgtattgttaggaagggcttcagggttttcttgtgtgatcccatcaataaataggtgctgtaacatgaattttaaaaggctacgctttcctacagaatttatgtaagttcctgtccgcagattttgtacattctgtataacacgtttatctgccttgctgcaaaaatccatagtagagttaagatactccgtaggccaggaaaccgaatctaaattaatgtcatcagcaagttgttcaagatctaaagaaaagcgaatgccgtgacttgaaattataatctgacggtattttgcaggtacacagaaaaaagagggttttgtagttcgaagagccgcttcaacttctagaggatttgatcccatagcttgtagatttttttgggatactggaaccaatgttgttaatttataatgagacgccgtgtctcctgaacgaccaggaataggcacatactgaggagctctttctaaaatcttagatacaagtaagtgattagcatatttagcatgtagaaaatagtgtagggctaaagcgattaaaatcagagggaagattaagaaggataaaatctttaatattttcactattgtggagatccgaacgttttctacttttccaataattaagttaggttcttgcataactatagatacaaccttgattctattcccgcctaagaaaagataagaatctacctttgacataagctgaaatatccaaggtgtatctacatctgaagagatgctataaagtttcataattcgaaaaggcgattgtatattgtataaagtgtaaacaaattataaaatgtatatcgatcattcatacccctacaccagcgacacctctttgcacggagggggaaatttttccaggtcctgtagattctgcaattcagaatgatctcgagagattactcacagtaaagaaaagacctgatatcatccgggagtatttgcgagcaggaggtagtcttgttacaacataccctaaggaaggtcagagattgcgctccccagaacagttaagagttctggatgatttagtgcaaagctatccaaatcacctacatgcgattgaacttgattgtggtgcaatccctcaagatttgatcggagccacctatatcatcacgttcgccgatttttccacctatattctctctttaagaagctaccaagccaattctccctccgatgatacatgggggatttggtttggatctattgacgatcctgttcaagcagtcatatcatttttaaaagatcatggatttgctcttccctcgaccttagctcaagatcctttgctttgtactaacaagtaatttattaagtgaaataaataatataaattaaaaatttatcgcttaattgtgttttaaatgtatttatattaaaataattttttcttttttaaaacagcttatgactagaagtactattgaaagcagtgattcgctatgctcaaggtctttttctcaaaaattaagtgtccagacattaaaaaatctctgtgaaagtagattaatgaagatcacttctcttgtgattgctttcctaactctaattgtggggggtgctcttatagctttagcaggagggggggttctttctttccctcttgggctaatcttaggaagcgtactcgttttgttttcttctatctatttagtctcttgttgtaaattttttactttaaaagagatgacaatgacctgtagtgtcaaatctaaaatcaatatatggtttgaaaagcaacgaaacaaagacatcgaaaaggcattagagaatccagatctctttggagaaaataagagaaatgttggaaatcgttcggcaagaaatcaactagaaatgatcttacacgagactgacggaattattttgaaaagatatatgaaaggagctaaaatgtacttttatttatgaattgggttccaaaaacaatagaccatgtagatccagaatcagagatagatatacgtaaagtcgtctcctgctataagttgataaaagaatgtcaacctgaatttcgatctcttataagtgaattactaggagtgattcggtgtggcttaagactattaaaacgttctaagtatcaagaacaggctagaactgtatctgatgaagatgcacctcttttctgcctgactcgttcttattatcaagatggttatctcacgccattaagagcaggacctcgtgatcttataaatcactatatacacttgcgtcgccgagagaatcctaagcattttttcagtcctaagcatccatgttattatgctcgattggcttttaatgagtcagtgtgtgtctatagagaactctttgatatagagcgacttacaaaaatgtatgtcgagggtgattattctaaagaacaagagaaaaacctacaggctattcttagttttgtgaaaactctagatgaaggaaaggactttcttattgaacataaagataccgatctcattgggagaggttttactgatgtgttctgcacttaaatcaatgaaattgtctcaaacaatataataaaagcgattctattatgtctgaaagtattaacagaagcattcatttagaagcctctacaccattttttataaaattaacgaatctctgtgaaagtagattagttaagatcacttctcttgttatttctctattagctttagtgggtgcgggagtcactcttgtggttttatttgtagctgggatccttcctttacttcctgtactcatcttagaaattattttaataaccgtccttgtcttgcttttttgtttggtattggaaccttatttaatagaaaaacctagtaaaataaaggaactacctaaagtagacgagctatctgtagtagaaacggacagtactctttaaaattatatttaatgtatagggctaatcggagtacgcatttgaatatcagagcaattactaaaggaattatgagcaggtaagataggatcttcagtgtacagtgtacagttcatagagcctggcttgaatttcctatctttagcactcaattcttccacagtgattccttgatcctgtttgcttaggaagactatttgagactgtcccagatcaaaataagaatctacggttgcagctaaacgttctaagccgtaattctcgctatttaaaaaaggtttagcaagaaggatggtagggcaaaaagggagcataaaaaatcctcttgggaaatgcgaccacaaattttacatcatctgttctattaatgctatttctattttacgaattcatgcaacataataacaattatcagactttatatggagatcctagtagactatcgtaaggcttaagaacaaaatatatcggcgccacctctcccaataaaagtggtgtctttatgtgtagcaagaaagtcgtcaaagccgtccttctcatctaaaatttgcacaaaactaagaatcgactttaggttgtcttcgttttgctgctcataatcacccgcgccatacatttgtttaagttccgctgtgttaaagagttttcgatagatacgcactgactcattaaaggccaatcgagcatagtaacatggatgcccaggattaaaaaaatgctcaggattctcacgccgacgtaagtttatatagctctatttataatataacgcggtcctgctcgtagtggtgtaagatagccatctcgataataagaatgagtcgggcagaaaagaggtgcatctttatgggatacagttttagctcgctcttgatacctagaacaacggcttaataaccctaagccactctgcatcgctcttagtaattcacttataagagatcgaaattcaggtttacatgctttaattaacttataacaggagatgactgtacgtatagagtcttctgatactggatctacatcgtccattgtttttggaacccagttcataaataaaagtacatctagattcctctcatagatctttttcaaaacatttccatcacaatcgcgtaaagtctcttttacttgacttcttgcagagcgattattgtcttccgccctattttctccaaagagctcaggattttccgtagccttttcaagatctttatttcgttgcttttgaaaccattggtggatttgagagtcggtattgtagacaacccctagctcttttatagggcagaatttatatgaaaaaagtaagaataaagcacaaagcacaacgagcacaattcccaagactaaccaaggaagaaaagaaagaatgcctgctccagctaaagccgtgagagtaattcccccaactaaagctaacaaagcgataacaaaagaagttatcttcactaatctactttcacacagatttcttaatggctgggtatttaattccataactaatggttgtgaacactctgaaccaacatttttcatgttattttctccgatagtgaattctatatgaaaagattaacactgtactttcaaataatttttaaaagattaagtttaatatttatacaaatataaactaattatttcgtttcgtgaatcttgtaaaataactaagaaaaagtatcggtatgagtcacagatcaaaaagagatatttgtcatagcatgttttataagaaattcttttctgtgattttcttatctaagctagacaggtctttcctcttgtttccaacaaaaagtcgagttattttatatttaagctacgttaaaaggcaatcttaaatcatcatatcaaaaatttaatgagacaccctccccttcgagctctcttttcttcccatcgactctcttgaaagcttcttctctggagacgcttttttttaacattactgctttagaatagaaataaagtaagaagaaaagctataagtcttaggaacttataaaaaataaaaaggaaatttagtgggtcgtatctatagtttttctcctggaacttatcctaactggcaagtaactcttatgggtaaactagatggctgttttcgtttaagagacgagaaagtcactcgggttatctcgatcaatccctctggatttaccttagctgacgaaaaaatagtccgggtctctatgccttctccagcatgagcttcacaaccaaaccctgagtcataagcatttctatatccagaagctaatcgcttaggacaggctccgggcgcagattctgatcctgcggattgtatccctacaaatagaccaggaaatgtagaatcaacctcttggagccattgaacagcttcttgggcaggttcttgtgtgtttatttgtggagcaaatgttttattgaagcagtttaaaaatcgtaaagtaatcccgtgttttgaaaacgtttgcgaagcacgatacaagatttgataaaacttcatacgcgcgtgcttttcaggtaatgaaggatacaaaacatgggcaaggcggatattttgttgtacttcagtatacacgatagtatcgtccagacattgctggagatagttattgaaaatgagaagaaggtcttcttcattttggattcctccaggaggaaagcgatgtccttgtactgtagccatcactctatcaaagctattaaaatcgtaatttaagatattatattgtaatacacttaaatccggatccttttcgtgacagatatcttgaaagtttcggaaaatattggagtattgtttatgaggattcttaggagaaagtaatcgatgattggtccaagaattataagaccattttaagaacccatttttcacacctaaaatccaagctaattgaggtgttatggtcccaggaaggtgtacatggatatctgctttggggaggtttttgatgatagcttcggtgcaagcgattgtattgagtcgtggtactaatgcaaagatctcattgcatatcttatgtacagaatcttccttttcaagattcttgaataacgtatcataagacatagaaagaacgaacgctataactgtgcaagtgttatacttttctcctctaatgatatgatttttacgaacattctaatgatgttactaaataacgagtctttgatttacccctatggtggctattcccattctatagttgctggtggcttgtcagaaatatcatagaccactcggcttacctcgggtatttcattaataattcgcgatgagcaagaactgagaacatcgcatggaaggtaggcccatcgtcctgtcatgaaatctgtagattctacagcacgtaatgctatggtataaccatagcttctacaatctccttttacagatactgattttataggaagaaatagagcaaaggcttggcttattttatcgtagagttttgctttcctaagctcttctataaagatgaggtccgcccgtcgtaaaatggctagatattcaggaaggatctctccaatcacacgaattgtcaagccaggtccaggaaaaggatgcctgtccaagagatagctagaaagtcctagggcttctcctaaaattcgaacttcatctttaaataaataacgtaagggctcgactaacttcagcttaagattttttggaagcccccctacattatgatgtgattttattacttcggaggcatgtccagagcgtgaggactcaataacatctgagtagatggttccttgagctaaccattgtacgtctaatgactgagcgacttcatcaaatacttcaataacggtatcttgaattttacttacaaggtcttgctgaatatacaagggattccatagtgtgggagcagaacagatctcttgaacaaaagtttctagaatcttatttcccgttggagtggagtcagaaacctcgggatgaaattgcagcccgtacaaccgttgtttggtattttctattcctgagatcgagcattgtgaggtggatgcgattacattaaatccttcaggaattgtcgtaacatgatcccgatggctcatccgaatctctgtgtctagagattcgcagtcgacgatgtgtttgaagagctcacaaggatacagatggatgggcgtatatccaaattctcctacaccagggcttacagtccctccaaaatctctagccataagctgcatgccatagcaaatagctagaattggaatgccaagtttatagatttcaggatctaaatgtggagccttgttttcatagacagagtgaggacctcctgagagaatgatccccaaaggcgctctttcttttaaacattgcacagagatattccagggaagaacttcgcaatatacaaataacttccgcacttgctttgctaatacataagtatattgagatccaaaatctagaataaatatggtgttcaaatgtctccttgcactctgcaacttaataatttaaggttggttgaactttgtaaatattatgaatatgactttcagctcttccagattcagtaattcgaacaaaggaagccttagtttttaaatctttgagagtttcagctccaacataccccatacctgagcgtattcctcctaaaatttgatagaggacatcgtggacagagcctttataagcgactagtccttcaactcccccaggaaccagctttttctgtccctgtgtttgaaaataccggtcagcacttccttgtttcatagcgcctaaagatcccatgccgcggtaccttttaaaaagcttctcatcgatagaaacgatatccccaggagcttcatcagtccctgcaagcaaacttcctagcatgacacagtctgctcctgctgctaatgcttttaccacatctccagaatagcggattctcccatcagcaattacagtcacggcagagtttttaagagcttttgctacgtttgtaatggcagtaatttgtggataaccgacccctgaaacgattctagttgtacagatagatcctgggccaatacctacctttacagcgtcaactccaatctcagctaaggaaactgcggcttcagctgtaacaagattccctacaactaaagaaatttgtgggaactgggattttatttctaaaactgtttggaatactcctttagagtgtgcatgagctgtgtcaatgactagaacatttgctccagcttccacaagatgatgcgctcttgaaattcctaaaggaccaatgcctatagcggctcctatgggagcttaaggataggcttctttaatttttctcacagatgagctttgttctacttcgctcatatttttatgtaagattcccaaaccaccttcttgagctaaagctagtgccatggctgtttctgtgacagaatccatagcagctgaaagaatcggtatatttagagagagggtttttgaaatggccgttttcaaggacacttcagaaggaagtatttcagaatattgggggattaaaagaacatcatcaaaagttaaggcttcttccatgtatgctacaataggacactttaaaggatagtcaatgatcccctgctatactgtcaatgcttttttcatgattcgtgacattccttcgaatcttaagaagaaatttctttggaacagaagtttcttcttccgtgtttaggcttcttattgaacttatagcttagaaaagattgaaggaaggaaagataagactatattgattctcttgtcttaagatatacgacgacagcactccctattcctacactcgataataagtagaaccaatactataagagataagatcccaaatacaagtgaagctgtttctccagaagttccataaacagaaaaacaaatgatgatgctaagtagggataaaaagataaagagacatcgggaacagtaatgacaacaattcgataccaaagtttttgcatctatatcctcgattggggaggggctcgttgattcaacgaatctatccggaaatacgctaaagtccataaaaccttgttgatgtttgtaagaatctattttgtagatgagatcgaaaatcgtctaacgatctgattcttctcaatactttatttgcctggaatcataaaaccctcaacctcttcgatgtcgttgtgtggcgcaatctattgcaaatcacgaaaatacttgattgagggcttcggagaaatttgaaggggtgatgcacaataggtgccagttcttgcgttttttaaaaaatttttatatggtttgtggagaaaattgttatactatcaatgattatgactactatatctaactcaccctcccctgcattgaatcccgaactttcccttattcctccaccaacacttgtatcttcaggtacgcaaacatctctagcttatacgatccccgcacaaggacgaagatccaccctacgtattatattagatatattcattatcattcttggtttagctacgatcatttctacctttattgttattttctttttaaatgggctgaacttgctctcgaccccatctattatctcttcgtcatgtttaatcattgttggattgctttttttgattatggggttatatttcatgatctcgagtttggatcaggggcttgtaggccttctgcaaaaggaactctctcaagccgaagaaagagaagaagagtatatccaggaaatcgaagctttaagaggagctcctagagcagaatctcccacagagtctcctagtacctggttatgatttacaggtatgaagttcttattttctaaaatttgtcagcagtttttcttttataagcatactttttaattcttgtatttaaattccttacgacaaaagggtgaaaaacgtcttgtagaacattctagcttctattagcctgtttccaatttttattaaggagacgcgatatggagcaacccaattgtgtgattcaggatactacaactgttttgtatgccttaaatagctttgatcctagacttagtgatgacactcacagacttgggaagcaatcacctcttgaagcagaaaatgctcttggagaatttattgaaggtttggatacaaatagctttcctttagaggaagttgccattcccatcctgccaggttatcaccctaagttttatttatctttcatagatagggacgatcaaggtgtccactatgaagttttagatggcgtatttttaaagacagtcgctgcttgtattatagagaactccttcttaactgattctatgagcccggagcttctcagcgaagttaaggaagctctgaaacgatgatgatcctatggatgaatccgatggagaagaagcttcaaaagattctgcattttcagctagtttttcctatgagtttgtaaaatcaagtactcgagaatctaaaaatacagtcacacactcaacagcgtctcgtacattatatattttaaggcaggattgttcttatgatccaagagctctcaaagtagatgatgaatttcgttattgggtagaaaaaaggttggacgccaagaatccagattcattaaatgcgttcgttaaagaggtaggaactcattatgtcgcgtcagtgacttacggtggcattggttttcaagtgctaaagatgtcttatctccaagtcgaggagttagagaaagaaaaaatctcgatatctgtagctgcagcaagttctttattaaaaagtaaaacatcgaacgcgacagagaaaggttattcttcgtatcagtcggaatcatcagctcaaacagtatttcttggtggaacagtattacctgatctccagcaagacaagttggatttcaaagattggtctgaaagcattcctaatgagcccattcctctagctattagtgtatcttcaattacagatctcataattccagaacttttcccttctgaagatgctcaagtcttatcccagaagaaatcagctctaggacaagttattcttaattatctagagagtcacaagcctaaagaagaaggcccaaaaccagtccaaattacttctggattcaattcatcgtcttcggtatttacgcttcaagcagcaaaagctcctaagactgtgtctttcccctatatagattattggtctacaattccctatcttttccccactcttaaagaaacttcaggtgctcaacctctctcgttctacttgaggtttgatgacatctttgagcaacaaaatttagtccataatacttcatatattttagcttcaacctcggtgaggttaggatatttcggagattcatatagagattatgatgctctatctttctatggtagttggcctcaagcatattttgactgggcaggctataaagataggtgtacttggaccttagaaaaactcaatacaactggagatcttttcatccgttctggagacgagatacgtttaaaacacaatacctctgggaaatatcttgctacaacgagcatgtctgatggctatcagaaattaacttgtacgacacagacgagtgattctgtctttataattactgtataaatagagttaagacatccccttaagttttaaggggatgtcttatttgctttctagagaactcatctctaagtaaacttcttttcttagggctgaggaggaactttcttatagctttcatgaacacagagtatagaagttccgtttgctaaaaacgtgcttctgaggtagtcctctgcaaaggaatctccaaaagcattcagagaatcagaggaagaaacgctttcccagactaaagaatagtacccttttacaggtaggacctcttttgagcaagcactctcatctgcaatccaggcataagcaatgacaaaaggattcccctgaggatacgagcacacttcaacgggatacaggctataaacaccttctcgccttctagctattacaaagtcttcttctgtcatctcaaggcctatagcattacagcgtcgtcccgaagatttaatgagattcagtacagctcgatttttcggaccatcgtgagaagttctacggcgacttccgttttttaagtactttcctgtgtctatattaaaagaacgctcgtatccatttatccaaataggatgtggacgatacgtttttaatgtaagagctgctgattttgggtgcatcagacttccataagtcgatatgggaatgtaagaacctttgattttgagatttttatggatttctctccaaattttacgagactcttcatcagtcttagctacgacataaggatcattgtgctcttcagaaaagatttgagtcgtacgaaatgcagaaggataatgaggcagttgcgaaacactcttatttccatgaacaaagaattcttcgctcgttgaagtgttgtgataattccaagagggcttttgattacaggaggaaagagatccaagacctaatcctaaacatacacttgaaaagataagagacatgggctgtttcatggattcctcggagattaagaaaatgaattttgatttcgtttgctctcttttgtcctacttaaaggagcttttcaacaacgtttcggtctgaaattttgctaaacaagaccctgccgttaccctagcttgtcccagcttctctagcataatttgaaaattgtaaaggaaatatatgaaaaaaggaatacgaaacccaccctatctaaggaattcttaattctgaacgtatagtatccagaactaagaattctctatcttaggaagtctataatgaaagcaccccgagattcgggagagaacttttgttagtgcatgccttgaacagtttagtccaagtacacccacacttctctttctctgttttcataacctgtgataatgcctagcgcgagcagttgttttaaaatgctctcacctaaacaaagcttaccatgcccaggttcggtcttaccagctatatggaaaagctgacctgtagttgttttagcatctatagattctcctccaaatttctgagagaccgtacagtgacgttttgtttgaggatctctttcaacattccgttgcactagaaaatctaagtattctttcactcaatctaacttctcctcataagaaaggttaggtttgccttcaagatgcataggagcggagagatctaaagcataactcaacttagtgaaaattaaggaggacatgaactttctgtctttcttaagagatcttggcaacttagcgatcaatccctttaagaagtgatgaggtactacctttaaaatctttcgcactaacgcggcttgctggttgtgttgtgcttcaaggtcttgttcattaaagaaccctatagattcaaaaatacaggaatagttaggagtttttgcgtcatttacatttaagaggatcgctttttttcctggaatgattccagaacggcctgcttgcaaagtaaaattaaagaaattagcaacacatgcttttgatggacgcgagcttcttcctgatttgtggaatgatttacgaagtcttctgttaaactttggaactgaggttgcttcaattctagtttcgaaatgagtatcccagatcttaggtcaagcccaacaacccttggaacctcaatatttcgaattttacacgctgcaagtaggtttcttgcatgtgttctacgtaccatagcctctacaagaacattatctagaggattagataagccattcatctcattgttttttgaagatacaaatgtaaagcggagattcggataattatctacacaaaaagtaaatacggaataatgattagtatgataaacatctaataaacagattttcttagcctcgagaatctgattagcccgagcaggatggcaatccgcttgattaaaataggcatcacgtacttccctctgagcgtgcaatatctgagaaggatacgtttcagacgccacggtattctggataaagactggcttatacttacaatccagaatcttatgtaaagacgtctaacacaataaatctccctagaaatatcgtctctagctagaacatctgttgtatcccctccccaatagaaataagagtcgagggcttgcacagctttttctaaactgctaggtttttcatgatgagaatttaaagaataattattataaaatagcttcataaattttttaaaaaaataataaacgccgtctattttaaacaattcatgcacttattaagaagctattaattcaacaacagcttaataaatttaaaaatcatctttttataaagaaatatttatataaaaataattcttagaccattgtaaatttaattagaaaagcctccgagcttcaagagccctaaggaagattcttaaattatttagaattctttaaaaaaagaatttccttgagcaagtaggttatcgatatagttaatatcgtaattagattctagaaacttcggattatccaacataaactggtggaaaggtattgtagactgcacaccaccgatatgaaactctttcaaagctcgtttcatgatagctatagcttcttctcggtttttgcccttagcaattacctttgctatcatagaatcataataaggagggattgcatagccgctataacaagctccatctacacgaattgaaggacctgcaggaggaagataataatctaaacgacctggagatggtgagaaattattggtaggatcctcagcgttaatgcgacattggatgatatgacccgagaactcaatgttcttttgtttccaaggcagcttatttcccatggctacatgaatctgttcttttacaagatctatacctgtgacttcttcagtaatggtatgctctacctgaattcgggtattcatttccataaagtagaattttttgtctttatctaataagaattcgactgttccaacagaaaaatatccggcgcttcttgctagatctacagcaacttttcctactttgactcggatttccgcattgagaatgggactaggagtctcttcaatcaacttttgacgtcgccgttgaatggtgcagtctctttctcctaaatgcacataatttccatgggtatccccaatgacttggatttctaaatgccttggattttctataaacttttcaatataaacattggggttattaaaaccggcttcggcttctgcacgtgcggcagaaaacgctctatagaattcgtccttttctttaacaatacgaattcctcttcccccacctccagcaacggctttaataacaatagggaaacctattttttcagctatttttaaaccttcgctctcgtcttcaataatgccttcagaacctggaataacaggacatttgattttctttgccagggacttcgcagcaatcttatcccccatcatagcaatagactctgaactcggccctataaaggttaagccacagctctcgcatattgaagcaaagtttgcgttttcacttaaaaacccatatccaggatgcacagcatcagctcctgtgatctcacaggcagccaagatattggatatctttaaataagactttgctgcttgaggctctccaatacaaatagcctcgtcagcaagaagtacgtggagagcctcttgatctgctaaagaatatacagccactgtcgacaatcctaaatcatgacaggcacgtataattctaacagcaatttcccctctattagcgattaagacttttttcatgatgcatctttagctatacgaaacaacttagacccaaattggacaggatccccattggtaatcaatacttcaagaacacgcccactcattcctgctttcacttcattcattactttcatagcctcaacgatacaaacaatagtatcttccgaaacaatatcgccaggttttacaaaagaaggagaatctggggctggagaaccatagaaagttcccactaaaggagaacttataaagtctccggaacttgttgtagtagaagtttctgaattttctgtagtagtctctttaattgtatcttttttagggtccgttgggataggtcgttcttgagaaaatccactaaataacctgctgtcataaaacacaggctcttgtctattcccctccctagtatctctttccaactccaattcaagcccttcacgttttatagcaaaacgcttcataccattgcgtcccatagcaatcatgagcttttctatttgttttaagtccataccaagtcttctttaattgaaattagacgcgttgaatatactcacaagtccgcgtatctatttttataacatcaccaatttctacaaaaggtgggaccataacttcaattcctgtttccagcaaagctttcttaactcctccggaaagagagagagaatctccaggaaagtctgtttttgataccataagctctagaaaatgaggcagctctacagaaaaaaccacattgtcatagaccattgcagagacagtcacacctgcctttaaaaacaaaaagttatccttcatgatttcttgtggaatgaataacttttcataatttcctaaatctaaaaaaagataactttcatcttcaagatataaatattctaaagtgcgggtttcaaattgagcctcttttacctcttgagttgctttgaaatttctctcaataacaacatcagaatccgcagcctgcaaagcgactttaatgaaggattcgcctttgggccctgccaccttagacactgaggttactttataaagaccgtcctttgtagaaataaacatccctacggataattggctacttaacaccataattttctcctcgcagcaacaaaattttatcttccattgctaatgaatctgcttcgaataagtaagaagctgtgactaaaatatctgctcctgcatctcgacataacggcgcagattgctgatctatgcctccatctacttctattaaacaagaatcctttaaacctaaagtctttatcgcatgacgtgcaaaagcaatcttttctattgtatttggtaaaaagctctgtcctgtaaatcccggataaactgacattagcacaacgacatcacaaaacggaaggaaagaaggaagaaattcgattgaagtatcgggagaaaaagctagacccgcttgaaccccacatttttttatataagatagaagctcttttatatcctctgaagcttcaaagtgtactataattctatccgcaccagaacgaacgaaactttctataaattcaaaaggattgtaaatcatagcgtggacttctaaaaatagatccgtagatctattaatggcagcaatgatccctggaccaaaagtaaggttcggaacaaagtggccatccatgatatctatgtgtataaaatcacttcccgcctgctctagtttttttgcttctacacccaaacaggtaagatctgcccccataatcgaagggccaactaatacggattcctgtttcttcacctcagcctatctcaacttcactacgctaaatttaaagtagagtgagctttaactttctactatttatatttactggttgatgtattcatgaactcctactcattgtatgaatagaaaatgaatacggactactaccataatacagaacgaatatatttcaaagaaccattgaacatttcttattaaaaattcttttctttttatacaaaaatcccaagattaatctttctgtttcactaatgaaaatgcatttggagataaggattatgatatagcaaatatattgtgattctaacctcctataccttcatcaaacatcaaattagtgaaataaagatgattaaatatattttggatcctcagcaagaaaggtataaatttcttgatttttagatcgagaaaaacaacaattcttatccaagttaacctattaaggataaaattcttatgtcatctcctgtaaataacacaccctcagcaccaaacattccaataccagcgcccacgactccaggtattcctacaacaaaacctcgttctagtttcattgaaaaggttatcattgtagctaagtacatactatttgcaattgcagccacatcaggagcactcggaacaattctaggtctatctggagcgctaaccccaggaataggtattgcccttcttgttatcttctttgtttctatggtgcttttaggtttaatccttaaagattctataagtggaggagaagaacgcaggctcagagaagaggtctctcgatttacaagtgagaatcaacggttgacagtcataaccacaacacttgagactgaagtaaaggatttaaaagcagctaaagatcaacttacacttgaaatcgaagcatttagaaatgaaaacggtaatttaaaaacaactgctgaggacttagaagagcaggtttctaaacttagcgaacaattagaagcactagagcgaattaatcaacttatccaagcaaacgctggagatgctcaagaaatttcgtctgaactaaagaaattaataagcggttgggattccaaagttgttgaacagataaatacttctattcaagcattgaaagtgttattgggtcaagagtgggtgcaagaggctcaaacacacgttaaagcaatgcaagagcaaattcaagcattgcaagctgaaattctaggaatgcacaatcaatctacagcattgcaaaagtcagttgagaatctattagtacaagatcaagctctaacaagagtagtaggtgagttgttagagtctgagaacaagctaagccaagcttgttctgcgctacgtcaagaaatagaaaagttggcccaacatgaaacatctttgcaacaacgtattgatgcgatgctagcccaagagcaaaatttggcagagcaggtcacagcccttgaaaaaatgaaacaagaagctcagaaggctgagtccgagttcattgcttgtgtacgtgatcgaactttcggacgtcgtgaaacacctccaccaacaacacctgtagttgaaggtgatgaaagtcaagaagaagacgaaggaggtactcccccagtatcacaaccatcttcacccgtagatagagcaacaggagatggtcagtaatctgccgtaaagtcttcaaagacttccttagaaaataagcagtaaagttttaactttactgcttatttttttttgaaatgaactcactcattaaagatatttgcaacaaattttcctgcgtcttatgcttgttcttttaggattgagtttttctcacttacactagaaccctacctatgcattcaaaatttctttctcgaagaaaaaaaaatagttctcataaggaggaaacctcttgggattgtatagcctcaagttacaataagatagtccaagataaagggcactactatcatagagaaactatccttccccaactcctgccttcactcaccttaggttcaaaaagttctgtattggatattggctgcggtcaaggttttttagaaagggcccttcctaaggaatgtcgttatctaggcatagatatctcttctagattgattgctctagcaaagaaaatgcgatcggtaaactctcatcagtttaaggttgcagatcttagcaaacgcctagagttcgtagaaccgacattattctctcatgcagtagcaatcctctcccttcaaaatatggaattccccggagaggctatacgtaatacagctacgctcctcgaaccactcgggcaattttttatagttttaaaccatccttgttttcgtattcctagggcatcatcctggcactatgatgaaaataaaaaagctatctctcgtcatatagatcgttatctctccccaatgaaaatcccaatcatggctcacccaggacaaaaagattcgccttctaccctctcctttcactttcctctaagctattggtttaaagaactgtcttctcatggattcttagtttcaggtcttgaggaatggacatcttcaaaaacctcaacaggaaaacgagctaaggcagaaaacctttgtcgaaaggaatttccattattccttatgatttcatgcattaagataaaataaatttttaattatttaattaggttttttattagaataaataaaaaacactaaattcttgcattatgtttcgaaaacttttcccgttttctaaaaaaaaaacaggtcagaagcaacgtcttcgaaacaatggacttctgcaagcgatcattcaatcaataaaagtcttactacataacgaagcttccaaggaagcctgcgtgttaagctactatggtttgcttacttgtgttcctattttagtattctttctaaggctttcccaacacttattcactaatctgaattggaaagaatggttgattatcaaattcccagattataaaaagccaatcgtagctattgtggaagccgcatatcatgctacagaaagcaatataggattagtcctagttggaagcttttttgttttctgttgggctggcattttaatgctcttatctctagaagatggcctaaataagatcttccgcaccagctggactccaatatctttaaagaggttagtctcttattttgtgattaccttagtgagtcccatgatttttattatcgtctgtggttcctggatttatattacacagatcatgcctatccaatacgctaagttgttttctctcagccattccatgacagcattgtactttatttctaggtttgtcccctacctgctgctctacctagctctattttgctgttatgcttttcttcctcgcgttgcaatccaaaaaacatcagctcttatctctacgctaatcataggatctgtatggatagtctttcaaaaggcattctttagccttcaagtctctatttttaactatagcttcacttatggcgccctcgtagccctgccttcattccttctcctgctatatatctatacaatgatctacctattcggaggagcactgacatttattatccagaatcgagggtgcactttcatatttcttggggacaaaatcctgcccagctgttatttacaactcattacctcaacatatattctagctttgacaacacgtcagttcaatgaaggcctctcccctttaactgctcaattcatcgccaaacaatcgaaagtacctattggtgaggtctctcaatgtctagatgtattagaaaaagaaggttttctttttccttataacaatgggtaccagcctgtcttcaatttctctgaacttacaatcaaagatattgctgacaaactcctgcatcgggaaattttcaagaaattcaatcccgaccttgggattactttcatagaaaacagcttccagaacatatttaaccaagcttctaaaaataaagagaatcttactcttagcgagattgctaggcgaatcaaatgaaacgaagatcatggcttaaaattttgggaatctgtttaggcagcagcattgtcttgggattccttatattcttgccccaactactttcaacagaatcaaggaaataccttgtgttttccctgattcataaagaatccggactctcgtgttctgctgaagaacttaagatttcatggtttggacggcaaacagctagaaaaataaaactcactggagaagctaaagatgaggtcttttctgctgagaaattcgaactcgacggatctctattacgtcttctgatttataaaaagcctaaagggattactctatcaggatggtctttaaaaattaatgagcctgcctctatagaccatccttctgtgagtcacttagatccaggatctttacttacctacctaaatgactgcaagattatttctgagcacggatttatcactatgaagacagtatcaggatcttcattatctgtatcagggttttatctagagaaatcctcagaaaagttcatgacgaaatgcgtggtctctgaagatcagcaatccgggaacatctttatagagagtgtactttctcctgatgtcagtatttccgctcagttttcttcagttcccgttgcattttttaaaatttttatagcttcccctttctgggaccatcttctctcttatgaagacataatcaatctatcagcagaggcaacacataccaatgatggtaagatttctatgacagcctctggcgagggaaatcaaattcaaatgaagcttcaaggccatattcataaatccacattttatattgtagaagggagttcttcgttcatagaacttaaacctgagctcgcctcagctctttgcaaccagatcattccgctgtccacacccattactagtaagcaaatccatgctacggtctcttatgctaaaattcccttggatattacgaaatggaaacatattgaaattacctctcaagcacagctccctgaagtcgcaatacatccgaaagaccctaatcttgcattacagctgcgcgacacaaagctaggaattaaaaagacggagaaattctcagacatccgttactcctcatctacagtcttaggaggagcttctccctctcaccttaatggtttaatcagtatagataacaaaaaacatcttactaaatttcgtctacaacaagcacaactcccccacacctatctaagagccattttccctcaacctttcgtgatcaatgttcccctggatgttgcttattattcattaaatatcgaagggacgtacaaaaatgctcacttagaggcagatgctatcctagataacccgctattgaaattgtcatgctccatgtctggaacatggaaaaattttctttttaaagggcaaggaacgtaccactttaataaaaaatggcaggagattctctctccccacttctcttacgctgaagctagattctcaggaaaagcacaaattaccgatacgaatctctttttccctaaattttctggaaaaattactgcaagagaaaatgagctgctcatccatgcaaaatttggttcccctaatgaacctataaaacctgaaactacctctatactcatccacggacaattttgttctctgccactcagcctagtttctaatcacctagcccccttccatttgaagaaattgacattttccttccatacggatggaggtaagtttgtaaccaaaggaaacctccaagctcttattgagaatccagactatcccgacctaaataatacgcgtatcctaatccctgatcttcttctttctcttgatgaatcctcaacttcaccttcttcaaaagacttgaaaatccagggttctggagagatattttctttgcctctggattctattactaagacctatgggaaacaagtgcgtctctctccttattttggttcctctggagacttgaactttgtagtaaactacaatcctaaagatcagaataagctcacactactatctaactttaagtcagaagctctcctaggagaactgaagttagtcatggacttttctatgaagctatcttcaggaactcagggaactctccagtgggaagtgagcccagaacgttatgcaagtttctttaaaaacgcatcatgctctcccacctgtttgcttcatagaactgcaaatgtacgcttagacatctcaaaactctcttgtccagaggaaaccaaaggtttatcttgtctcacgcttcttgccgcaggaggacttgaaggttcattagaagcaacaccgttgatcttctatgataatgtgtctaaagagacttttattattaatgactttaaaggttctttgcgagccaacaatttagacgctaaaatagaatatgatcttaaaggctcgtgtctagctcctaggcaagactctaaaactcttgcagaattttcattagaaggacaggtagatcatctgttctctccagagtctcgagaatttaaacaaactgcaaattggattcacataccctcttcgttcattgctggaatcattcccatgtctccaggattgaaagctcagatatcctcgcttgcaggccctagaatcaacgtatcaattaaaaatgcgttccgatttggagaaggccctgtcgacattatggtcgactctgaaaaccttcaagctcagattccactgatcttaaacgaaaagtccatcttactgagagagaatctaacagcgcaccttagtataaatgaagatgtaaataaggctttcctacaagagtttaatcccctcttagcagggggagcctactcacaatacccagtaaccttagagatcgataaacaaaacttctatctccctatacgcccgtattcttttgaagaattccgcatccaatccgcaacattggatatggggaaaatctcaatagcaaatacaggaactatgtatgctcttttccaattccttgatattacggatcaaaagcaatttgtagaatcttggttcactccaattttcttttctgtacaaaaaggctctatcatttgtaagcgcctcgacgcccttatcgatcgtagaatccgccttgctctatgggggaaaactgatatcgctcatgatcgtctgtttatgaccttgggtatcgatcctgaagttattaagaaatactttcataacacctctttaaaaactaaaaacttcttccttataaaaatccgaggatccatctcgtctcctgaagtggactggtcttcagcttacgctagaatcgctctattaaaaagctacagtcttgggaacccgtttagtagtcttgccgataagctattctcttctcttggcgactctacccccccaccaacagtacaccccttcccttgggaaaaatctaattttgattctatagaaaataaatagaatcaatataaaaacttaacagttctttttaattaattatttttataaatcttaaaaataaaattaaattaattattaggaataaaactcatgagaaaacgtcactctttcgactcaacctctacaaaaaaagaagccgtcagtaaagctatccaaaaaatcatcaagattatggaaacaacagacccttctttaaatgtagaaacccccaatgcagaaatcgaaagcattctccaagaaatcaaagaaattaaacaaaagttatcgaaacaagcagaagacctcggtcttttagaaaaatactgttctcaagaaaccctctctaatcttgaaaacactaacgcatcgctcaagctttccataggcagtgtcatagaagaactcgcttctctcaaacaacttgtagaggaaagtattgaagaatccttagggcaacaagaccaactcatccaatctgtacttattgagatctctgataagtttctttcctctataggggagactctttctggaaatcttgatatgaaccagaacgtaattcaaggactcctaatcaaagaaaaccctgaaaaatctgaagcagcttctgtaggatatgtacagactctactagagcctctaagtaaaaggatcggcgagactcataagaaggtcgctactcatgatgtgaatatctcctccttgcaatttcatatgatgtcagtggcaggaggtaggttccgtggtcatattgatatgaatggctatcgcgttttaggattgggagagcctaaaaatggagaagatgctgtctctaaggattatttagaacgttacgtaagctcgcagctcactatagacaaagttgaagacaagcccattacaaagccaaataagggaaaattactctattcccaagggacgagtcctaaacttgaaagtcccttacctttagggcttctgacatctggaatctcaggatttacttggaaaagtgcaagcaaatctaacgatggaagcttcccttttagtgctttaagacacaaggaaacagagtcggatacagattgcttccagattacttccacaacgctctcaggaaatcaagcaggaacctacacctggtccttatctttaaaagtgttggtgccttcaatcttccaaatcgaaaaaccagaagtccagctctctcttgtctactcttatgaagactggcttcctatcgataatatcttcaatatgtctcagcctaggaccataccactagctctcctaggacaaacaatgcttgcaggacaaaaatatgatatcctagagctcgccgcacatcaaacaaaccaaactctaatgattagcccgaactgttctcgattctctctacaattaaaacaaactaatcagtttgaaaactcccctgtcgatttctatattgtccatgccgctcattcctgccactggtcaggattctaaagtatcactacagctgctctagcagctgtagtcctattgagcagagtggatatatttcgataatggatgaccagaatcgagctctccgtcacgcttgtcatagacccccgcaacagttccttgatctataagatagatacgatccaaacaactatgaacaaattgcatgtcatgagtagttaaccctacagtcagttcctggtctcgaagtgtttctaaaagatgtcggaacgatgccgtagcaaaaggatctaaagccgatgtaggttcatcaaaaagtaatgtatgtttatccatacataaagaacgtacaatagccacacgttgtttttgtcccccagagagctggtcaggataattcttagcaacctcttcaatatccaacaaatgtaaaagctcgaacgccttttctcgagcttcttcggtactacgacccttgatatggatttgtggatgggtgcaatttcctaatactgtcatatgggaaaataactcgggttgttggaaaactagagctggagcctccccttcaatccaaatatctccttgagtgggctggactaagcccgccaaagcacgtaaaatcattgtttttcctgaaccactcttcccaacaaacagtgtaatgtgccctcgctctaaagaaaaagttacaccatctagaatctttttcttatttacagagtaggcaaggtttcggactctaattgtcataactccttctcttttctgataacctagaaatacaggaaaatgatgttgtcattaagaaatatagcccagcacaaataagatacatttccatagggttcaactctctcgagacaatatccttagttactttagttaactcagggacaccgacaaccattaaaatactactttccttgatcaaagaaacaaattcattggttaaggatggtaaaatatttttaaaaacttgaggataaataatataaacgaaaatttgatacttcttatatcccaaaaccattgcggattcccactgccctatagaaagagaattgatacctccacggatattttctgcaagatatgctgcagaattcatacttaaagcaataattccagcaactagaggtgtgggttctatggggagaacttcaggcaatccaaaatatataatcaaaatttgaataaataaaggagtcccgcggataacagtcacataactattagctaaaagtttcgttaacttagaagggaagtatagagaagtcaccgttccaatcaaaagacctaaaatagaaccacatagaatgccgattccgctcacacataaggtgtatccgcatcctcttaacaacagtcttgctatagctagccaatgatccactccgacctcttatgcatatttatttataatgaaatcatatttatgcaattaatccaagaaaacttgcagtaaatttgcaatcgaaaccatcaacaatgggagcctcccttcatctataggagtgacaaaaatcgtgtcatctcctgccaaagttccaagaatttcatctttgagcccttgatctaacaaagcagcgatccaagaagctgaaccaggaaccgtacgaattacaataagagaggcgttatggcgaatagagagcaccaaatgacgggtcgtggtcttctctgttgaagagggtaaagaataacgagcaccacgctctccagcaacctttacagcctgaatctttcgtagccaacgagatacagacgactgggttgtagcaaaaccttgagctaagagttttgcacataattcctcctgagttgccgctccttcaagacgtaaaatttcttttaaagcctcatctatagttactttttttttcataaaaaccccatgtaacttttacttgctcatattgagaagtcccccatactataaaaggcaacgttttcttttcttggttttttatgctcaccctaggcttggaaagttcttgcgatgagactgcctgcgctatagttaatgaggataagcagatattagcaaatattattgcctctcaagatatccatgcatcctatggcggagtcgttcctgaacttgcttcaagagcacatctccatatcttcccacaagtgataaataaagctctacaacaggccaacttattgatcgaagatatggatctgattgcagtaacgcaaactccagggttgataggttctctatcagtaggagtgcattttggtaaaggcattgccataggagcaaaaaaatccttgattggagtcaatcacgtcgaagctcatctctatgctgcctatatggcagcgcaaaacgtgcaattccctgctttaggtcttgtggtctctggagctcataccgcagcgttttttatagaaaatcctacatcctataaactcataggaaaaactcgagatgatgctataggagaaacttttgataaagtaggacgctttctaggattaccataccctgcaggcccattaattgaaaaactcgctttagaaggctctgaggacagttatccttttagtccagctaaagtcccaaactatgacttttcattcagcggtcttaaaacagctgttctctacgcaatcaaaggaaataatagtagcccccgctctcctgctccagagatatctttagaaaaacaaagagatatcgctgcttcatttcaaaaagcggcctgcactactattgcacaaaaacttcccactattataaaagaattttcgtgccgatctatacttattggaggtggcgtagccattaatgaatactttagatccgcaatacaaactgcgtgtaatctacctgtatacttcccccctgctaaactatgctcagataatgctgctatgattgcaggtctagggggagaaaattttcaaaaaaactctagtattccggaaattcgtatatgcgcaagatatcagtgggaatctgtatcaccattctccttagcctctccgtagtcctccaaggctgcaaggagtccagtcactcctctacatctcggggagaactcgctattaatataagagatgaaccccgttctttagatccaagacaagtgcgacttctttcagaaatcagccttgtcaaacatatctatgagggattagttcaagaaaataatctttcaggaaatatagagcctgctcttgcagaagactactctctttcctcggacggactcacttatacttttaaactgaaatcagctttttggagtaatggcgaccccttaacagctgaagactttatagaatcttggaaacaagtagctactcaagaagtctcaggaatctatgcttttgccttgaatccaattaaaaatgtacgaaagatccaagagggacacctctccatagaccattttggagtgcactctcctaatgaatctacacttgttgttaccctggaatccccaacctcgcatttcttaaaacttttagctcttccagtctttttccccgttcataaatctcaaagaaccctgcaatccaaatctctacctatagcaagcggagctttctatcctaaaaatatcaaacaaaaacaatggataaaactctcaaaaaaccctcactactataatcaaagtcaggtggaaactaaaacgattacgattcacttcattcccgatgcaaacacagcagcaaaactatttaatcagggaaaactcaattggcaaggacctccttggggagaacgcattcctcaagaaaccctatccaatttacagtctaaggggcacttacactcttttgatgtcgcaggaacctcatggctcaccttcaatatcaataaattccccctcaacaatatgaagcttagagaagccttagcatcagccttagataaggaagctcttgtctcaactatattcttaggccgtgcaaaaactgccgatcatctcctacctacaaatattcatagctatcccgaacatcaaaaacaagagatggcacaacgccaagcttacgctaaaaaactctttaaagaagctttagaagaactccaaatcactgctaaagatctcgaacatcttaatcttatctttcccgtttcctcgtcagcaagttctttactagtccaacttatacgagaacagtggaaagaaagtttagggttcgctatccctattgtcggaaaggaatttgctcttctccaagcagacctatcttcagggaacttctctttagctacaggaggatggttcgcagactttgctgatcctatggcatttctaacgatctttgcttatccatcaggagttcctccttatgcaatcaaccataaggacttcctagaaattctacaaaacatagaacaagagcaagatcaccaaaaacgctcggaattagtgtcgcaagcttctctttacctagagacctttcatattattgagccgatctaccacgacgcatttcaatttgctatgaataaaaaactttctaatctaggagtctcaccaacaggagttgtggacttccgttatgctaaggaaaattagcacctcttttaatctcgcaaacttgtcaagaactgaatcttatactaaactgggtgcctttgtggcacctcgtttccttctgactgctcttctctctctactcaaccgcatccctaaaagttgaaatcttattctaaagaaaggtcttttatgctccgtttcttcgctgtatttatatcaactctttggctcattacctcaggatgttccccatcccaatcctctaaaggaatttttgtggtaaatatgaaggaaatgccacgctccttggatcctggaaaaactcgtctcattgcagaccaaactctaatgcgtcatctatatgaaggactcgtcgaagaacattcccaaaatggagagattaaaccagcccttgcagaaagctacaccatctccgaagacgggactcggtacacatttaaaatcaaaaacatcctttggagtaacggagaccctctgacagctcaagactttgtctcctcttggaaggaaatcctaaaggaagatgcgtcctccgtatatctctatgcgtttttacctatcaaaaatgctcgggcaatctttgatgatactgagtctccagaaaatctaggagtccgagctttagataagcgtcatctcgaaattcagttagaaactccctgcgcgcatttcctacatttcttgactcttcctatttttttccctgttcatgaaactctgcgaaactatagcacctcttttgaagagatgcccattacctgcggtgctttccgccctgtgtctctagaaaaaggcctgagactccatctagagaaaaaccctatgtaccataataaaagccgtgtgaaactacataaaattattgtacagtttatctcaaacgctaacactgcagccattctattcaaacataagaaattagattggcaaggacctccttggggagaacctatccctccagaaatctcagcttctctacatcaagatgaccagctcttttctcttccgggcgcttcgactacatggttactctttaatatacaaaaaaaaccttggaacaatgctaaattacgcaaggcattgagccttgcaatagacaaagatatgttaaccaaagtggtataccaaggtcttgcagaacctacagatcatatcctacatccaagactttatccagggacctatcccgaacggaaaagacaaaacgaaagaattcttgaggctcaacaactctttgaagaagctctagacgaacttcaaatgacacgcgaagatctagaaaaggaaactttgactttctcaaccttttctttttcttacggaaggatttgccaaatgctaagagaacaatggaagaaagtcttaaaatttactatccctatagtaggccaagagtttttcacaatacaaaaaaacttcctagaggggaactattccctaaccgtgaaccaatggaccgcagcatttattgatccgatgtcttatctcatgatctttgccaatcctggaggaatttccccctatcacctccaagattcacactttcaaactcttctcataaagatcactcaagaacataaaaaacacctacgaaatcagcttattattgaagcccttgactatttagaacactgtcacattctcgaaccactatgtcatccaaatcttcgaattgctttgaacaaaaacattaaaaactttaatctttttgttcgacgaacttcagactttcgttttatagaaaaactataggagaaaaagtttagacttaaaattcgatagtaaatttattaaagtaatttttaaaatgttttcacgatggatcaccctctttttattattcattagccttactggatgctcctcctactcttcaaaacataaacaatctttaattattcccatacatgacgaccctgtagctttttctcctgaacaagcaaaacgggccatggacctttctattgcccaacttctttttgatggtctgactagagaaactcatcgcgaatccaatgatttggaattagcgattgccagtcgctatacagtctctgaagacttttgctcttatacgttctttatcaaagacagcgctttatggagcgacggaacaccaatcacctccgaagatatccgtaacgcttgggagtatgcacaggagaactctccccacatacagatcttccaaggacttaacttctcaactccttcatcaaatgcaattacgattcatctcgactcgcccaaccccgattttcctaagcttcttgcctttcctgcatttgctatctttaaaccagaaaacccgaagctctttagcggtccgtatactcttgtagagtatttcccagggcataacattcatttaaagaaaaaccctaactattacgactaccactgcgtctccatcaactccatcaaactgctcattattcctgatatatatacagccatccacctcctaaacagaggcaaggtggactgggtaggacaaccctggcatcaagggattccttgggagctccataaacaatcgcaatatcactactacacctatcctgtagaaggtgccttctggctttgtctaaatacaaaatccccacacttaaatgatcttcaaaacagacatagactcgctacttgtattgataaacgttctatcattgaagaagctcttcaaggaacccaacaaccagcggaaacactgtcccgaggagctccacaaccaaatcaatataaaaaacaaaagcctctaactccacaagaaaaactcgtgcttacctatccctcagatattctaagatgccaacgcatagcagaaatcttaaaggaacaatggaaagctgctggaatagatttaatccttgaaggactcgaataccatctgtttgttaacaaacgaaaagtccaagactacgccatagcaacacagactggagttgcttattacccaggagcaaatctaatttctgaagaagacaagctcctgcaaaactttgagattatcccgatctactatctgagctatgactatctcactcaagattttatagagggagtaatctataatgcttctggagctgtagatctcaaatatacctatttcccctagacaaaagaagtctttggtaaggggttttttttattgaagagacctttcttcaccagtatactattgtatctttataagaagtttcttctgtatataaattgctatatgaagaaacagtaagtaataggagcattaggatacgcctccttaaggtatttctatcctgaaagatacaataatctcattcccccatcgactaaatccaccacggactccgacctcccatgtcttcaatccatatgaacgtaatattaagtagcaaattgagtactatataatgaagatgcataggcttaaacctaccttaaaaagtctgatccctaatcttcttttcttattgctcactctttcaagctgctcaaagcaaaaacaagaacccttaggaaaacatctcgttattgcgatgagccatgatctcgccgacctagatcctcgcaatgcctatttaagcagagatgcttccctagcaaaagccctctatgaaggactgacaagagaaactgatcaaggaatcgcactggctcttgcagaaagttataccctgtcaaaagatcataaggtctatacctttaaactcagaccttctgtgtggagcgatggcactccactcactgcttatgactttgaaaaatctataaaacaactgtacttcgaagaattttcaccttccatacatactttactcggcgtgattaaaaattcttcggcaatccacaatgctcaaaaatctctggaaactcttgggatacaggcaaaagatgatcttactttggtgattaccctagagcaacctttcccatactttctcacacttatcgctcgccccgtattctcccctgttcatcacacccttagggaatcctataagaaaggaacacccccatccacatacatctccaatgggccctttgtcttaaaaaaacatgaacaccaaaactacttaattttagaaaaaaatcctcactactatgatcatgaatcagtaaagttagaccgagtcaccttaaaaattatcccagacgcctccacagccacgaaacttttcaaaagtaaatctatagattggattggctcaccttggagcgctccgatatctaacgaagaccaaaaagttctctcccaagaaaagattcttacctattctgtttcaagcaccacccttcttatctataacctgcaaaaacctctaatacaaaataaagccctcaggaaagccattgctcatgctattgatagaaaatctatcttaagactcgtgccttcaggacaagaagctgtaactctagttcccccaaatctttcacaactcaatcttcaaaaagagatctcaacagaagaacgacaaacaaaagccagagcatattttcaagaagctaaagaaacactttctgaaaaagaactcgcagaactcagcatcctctatcctatagattcctcgaattcctccatcatagctcaagaaatccaaagacaacttaaagataccttaggattgaaaatcaaaatccaaggcatggagtaccactgctttttaaagaaacgtcgtcaaggagatttcttcatagcgacaggaggatggattgcggaatacgtaagccccgtagccttcctatctattctaggcaaccccagagacctcacacaatggagaaacagtgattacgaaaagactttagagaaactctatctccctcatgcctacaaagagaatttaaaacgcgcagaaatgataatagaagaagaaaccccgattatccccctgtatcacggcaaatatatttacgctatacatcctaaaatccagaatacattcggatctcttctaggccacacagatctcaaaaatatcgatatcttaagttagatccgaaatggaaaaattaaaaattttatagacaatcttgaaaagagaattaaaaatttttaatttaaattatagttgcaattgaaaacgcccctaagaatcggggcccctaactactgaatctacgtgaaatgcaattgttaaaaaaataagagatttatagaaaaataaaagtcttccttcccaacgcattttttgtattgaagatgactaaaaatgaaagtataatgacttaaacattttagagctgaggtctacttcaaggtagaaatgcttaatagggttgtctctcgtgttctcatacataaaaaaccgaattctttttaatttgctttctctatggattgttttgacactcacgttcctagttatgaaaaccatcccaggagatcctttcaatgacgaaggctgcaatgttctttccgaagaggtcttacaaaccctaaagtctcgatacggtttagataaacctctctatcaacaatacacacaatacctccactccatcgcaaaactagattttgggaactcgttagtttataaagatcgcaaagtaacgaacatcatttcgactgcctttcctatatcagcaatcctaggattgcaaagtctttttctctccataggaggggggatcgctctcggcaccatagcagcattaaaaaaaaagaaacaaagacgctatattctaggcgcctctatactccaaatctcgattcctgcttttatattcgcaacactcttacaatatgtctttgctgtaaaaattcctcttcttcctatcgcctgttggggaagctttactcatactatactcccgactctcgcacttgctgtaactcccatggccttcatcatacagcttacctactcttcagtatccgcagcattaaacaaagactatgtcctactagcctatgcaaaaggactctccccacttaaagtcgttataaaacatattttaccctacgccatattcccaaccatttcttattccgcattcctaactactacagtgattacaggaacctttgctatcgaaaatatcttctgtattcctggattaggtaaatggtttatttgtagtatcaaacaacgagactacccagtagcccttggcttatccgtattttatggaaccttatttatgctctcttctttactttctgacctgattcaatccattatagatccgcaaatccgttatgcgcacggaaaggaaaaaaaaagaaaataaaagtcataagaaaaaaagaagcataaacttatggaaaacctatcctcagctccatcacgtagcatttggaaatctataatccagaataaaatgcttgttctaggcctcacgaccctcataattctaatgcttggagccctccttttgccatggttctatcaagattatgaacagacttcattaaaagacattcttgtctctccatgctcgcgctttccctttggcacagacactctaggcaggtgcatgtttgcccgaactctacgaggtctacgactctccttactcatagcgacgatcgctacacttattgatgtgtgtgtgggacttttgtgggccactgttgctatatctggagggaaaaaaatagatttcttaatgatgcgaaccacagagattctcttttctctaccgagaatccccatcattattcttcttttagtcatcttccatcacggactgctcccgctaatccttgcaatgacaattacaggatggattcctatatctcgaattatctacggtcagtttctactcctgaaaaataagccctttgtcctttctgcaaaagccatgcatgcctccacgtttcatattctaaagaagcatcttcttcccaataccctagctcccatcatatctacattgatttttactattcctaacgctatctataccgaagccttcattagcttcctgggtctaggaatacagcctcctcaagcaagcctcggcaccttagttaaagagggaatcaatgctatagattactacccatggctatttttcttcccctctctaattatgattgccctctctataagcttcaatctcatcggcgagggggctaaaacactatgtctcgaagagggatctcatggataactacttactaaatatcaaggatctcacaataacctctacaaaccctaagagaactctaattgaaaatttatcactacagctcaaagaaaatcgaaatcttgctctagtcggagagagcggctcagggaaaactacaattaccaaagccatcctaggcttcctccccgaaaattgtctgatcaaaaccggaagtattttatttgaagatatagatattaccaagctctcaccaaaagagctccataagatccgcggtcaaaagatcgccacaatactacaaaatgctatgggttctctaaccccatccatgcgcataggaatgcaaatcatagaaaccttaagacaacaccacaaaatgaataaagaggaagcctataataaagctatgcaactccttaccgatgtttgcattcctaatccaaaatatagcttctcacaatacccctttgaattgagtggtggcatgcgccaacgtgttgtaatcgccatagcactcgcaagccaacctaagctcattcttgccgatgaacctacaacagccctagactctatgtcacaagctcaagtccttaggattcttcgtaatatccaacaacagaaacaagctacaatccttcttgttacccataacctctctctagtcaaagagctctgtaatgatatctgtattatcaaagacggcaaactcatagaaacaggaaccgttgaagagattttcctctctccgaaacacccctatactctcaagctcctcaatgctgtctctaaaatccctattaaaaaaaccagctctcccatccttaaaaataagttccaacctctaatgagtatgcaaggtggtttatgacaactctactaagtataaaggacctttccctaaccatcagaggaaagaaaattcttaatcatattaacctcaacctaatcaaaggaagctacttaacaatcgtaggacccagtggctcaggaaaatcttccttagcacttactattctggatctcctaaaacctaccacaggaacaatcacgtttcatatggaccccaagatccccagagcacgtaaggtccaagtgatctggcaggatatcgactcgagtctaaatccctgcatgtctataaaaggaattatttccgaacccctaaatatcatcggaacctattctaaagccgaacaaaataaagagatttataacgttcttgatcttgtgaacctccccaagtctgttctccaccttaagccttataaactcagtggaggacaaaaacaacgcatagccattgcaaaagctctagtctcaaaacccgagctccttatctgtgatgaacccctctcctcactagacacgctcaaccaatccctaatcttagacctttttcaaacaataaaaaaagaataccaaaatacccttctctttatcacccacgatatgtccgcagcgtattatattgcagacactatcgccgtcatggatcaaggaagtcttgtcgaacatgcttgtagagaaaaaattttctcaactcccaagcatacaactacacaagatcttctcgacgccatccccatattttccttgatctccacagaaatggaaccctcggaagaatacgaattacaagtcgcctcaaagtaaatagatttagaaataacgaattcttatagaaaaattaggatttttgacgtctctcaatagaaaaatgaaagtctgatatgatgaatcaaaaaaaccaatagttaatttgatttttgaattgttttttctcagaaagttccttgactccactaaaaactcgctatctagttataaaatagagtcaacgcctcctacggccgtccaatctagggttagatcaaaaaaacttaacactagaatcagacgccaattatttctaaactattgtattacaatcattcctatttgaattaaaccctttgaatccccataatgttcttgcttcaacaaacgcaaccattctaaaagaaccctcgccttctctattgcgacgtgtaccttaatttattgaaatataaagcatccgaaaactgtagttctattaagagctgggcgcttaggaaccttaagttattcctataaatcgtccccctcccccaaaaaaacaataaagagaccagttgtatgaatacctataccttctctcctacacttcagaaaagcttcagcctatttcttttagaaaaattagactcttactttttctttggagggactcgtacacaaatcttagtcatcacaccaaccaatattagattagcagctaaaaaaagagggtgtaaggtttctactatagaaaagataatcaagatcctctcttttatcctgctgcccctagttatcattgcctttatacttcgctatttcttacataagaaattcgataaacagttcttgtgtatcccaaaagtcatttctaacgaagacgaagctcttcttggatctagaccacaagcagttgaaaaagcagttcgagaaatatctccagccttcttctctataccaagaaaataccaacttattagaatcgacactcctaaagatgacgctccctcaatccttttccctataggcatagagatcattctcaaagatttatgtattgatacactcaagcaatctaatcttttccttaaaagagaaatggatttcttaggtcatccagaagaaaaagcattattcgactcgatatgttctatagaaaaagatcaagaatggatgagcttggaaagtaaaaaacttttaatcacgcacttcctaaagtatctctttgtctctggaatcgaacaactaaatccaggctttaacccagagaatgggcgtgggtatttttcagaaataagtacagcaaagatccattttcatcagcacggtcgatatgggccaatccgttcttcgggacccatcatgaaggaaatataaaaataaaaggcatgggctaccaaatcttcacaagacttaaaaaacttggaatctcattctcctcttataattccattaatcctaatccttacttcttcgatgaaggctgttttgtctattgggaatcccaatttaaatccgcactgcaagatcacgggattctccagaaacagacagaaacattctatagaaatacttaaatacatttctaagaagtctgtctaagagaactccaaacctataaaaaaacccttaaatatttcctaaatagaagactctataaaaggctatggttccgctagtgcctttagaaatccccctcagctattgctaaagttctttctagtatgtgaagagttatgtatacttactgttgctacacatagagctctcttagaaactcctttagctctatcattttttaaagaacttaagacaaaatatgtctacagggcgaaagacatactacaactacataactataaaggatttactatccttaatacatcaccgttatgttcttaatttctctatctgtaaatcgttgacagaagaagccctgcatgctacgactcaattaacagtgatgcaattggagtatctttgctaatggatatttcccatatcctggaagatcttgcctatgacgaagggatccttccaagggaagctatagaagcggctattgttaaacaaatgcaaattacgccttatttactgcatattttacacgacgctactcagcgcgtccctgagattgtaaatgatgggagttatcaaggtcacctctatgccatgtatctcctcgcacaattcagagaaagtcgcgcactccctctcatcattaaactctttgcatttgaagatgatactccacacgcaatagcaggtgatgtcctaaccgaagatctgcctaggatcctagctagcgtctgcaatgatgactcgctaattaaagagctcatagaaactccaaaaatcaatccttatgtgaaggcagccgcaatctctggtcttgtaactcttgtaggagccgggaaaattcctagggataaagttatccgttattttgcagaacttctaaactatagattagaaaaacagccctcgttcgcttgggataacctaatcgcagggatctgtactctttaccccggagagctcttctatccaataagcaaagcctttgacggaggacttgttgatacatctttcatcagcatggaagatgtcgaaaatattatccacgaagaaaccgtggaatcttgtatccataccctctgttcttctacagaactcattaatgacactctagaagaaatggaaaaatggttagaagacttccccatagaaccgtgacatcgatcaatcaatatttctaaccactacaccgaggtcctaagtgaacaaaaaaaaacgtttcttatctctcctctttctgactgcagtacttttaggcatttggttctctccccatcccgcatctataaattctaatgcttggcaactcttcgctatattcacaactactatcatgggaatcattttccagcccgtccccatgggagctattgccattattggaatctccacactactactcacacaaacgttaactctagaacaaggattgtcaggattccataatcctatagcgtggttagtcttcctctccttctcaatagcaaaaggaatcataaaaacaggactcggtgaacgaatcgcatacttctttgtcagtgctttggggaaaagtcctctaggactcagctatggactggtaatcacagattttttccttgcacctgcaatccccagcgtgactgctcgagctggagggattctctatcccgtagtcacgagcttatcagattcctttggaagttccgcagaaaaaggaactcaagatcttatcggatccttcctcattaaagttgcctatcaaagctcagtgatcaccagcgctatgttcctcactgctatggcaggaaaccctctggtggcagctctagcaggccacgtcggggtttctttatcttgggttctatgggcaaaagccgcaatcattccaggactccccagtctattcctcatgccgatcatactctacaaactctacccaccaaaaatcacatcttgtgaagaggctatccgatcggcaaaacttcgactcaaagaaatggggccgctaaaaaaagaagaaaaaacaatattgatgatctttttcctccttgtagtcctctggacttttggagatctcttaggaatctcagcaacaacagcagcccttataggactgtctctcctcatcctcactaatattctagattggcaaaaagatgtcatagcaaatacaacagcatgggaaacattcatctggttcggagccttaatcatgatggcttccttcttaaaccaactcgggtttatcccactcgtaggagactcagcagcagcactggtcagtggcctctcttggaaaattggcttccctctactcttcctgatctacttctactcccactacctttttgctagcaataccgcgcatatcggagccatgtatcccatattcctcgcagtctccatatcgttagggactaatcctatattcgcagcactcaccctagcattcgcaagcaacctttttggaggactcactcattacggatccggacccgcacccctctacttcgggtcacatctcgttactgtccaagagtggtggcggtcaggattcgctcttagcattgtcaatattgttatctggataggaatcggaagcttgtggtggaaagccctcggactcatttagaaaccaagtcttttatatagaaaatattctttagcaagtttatattttgtgaaatatgaaagctaaatcataggaccacctgtgatttagccttctgtcataagctctctttttatagcctaaagttgaagaaagcttagccgtaaaaggtcttgttgtattcttccaacgagttacaacgaaatacactaaagttcattctcaaagtagaatcattccttaaaataagacctttttaaaaaaacctgatgttcttatgcacaaaaagaatcccattgactttagccttgggatgatgcaaaaagcaaaattagagtgtagccgttatccttatgcatcctttatacgttgatcttgatactattatcagctcctactctcctcccttacctaaagaatttcaagaagcagcctctttaattgctgttccagatacttcacattctaagcctgtcgttccaggagtgaaaaccctctttccacaaacctaccaccttccctatctaaagtttgtccaaggagaaaatgtcgttcacactcctctaaaagtaggcgtaatgttctcaggaggacctgctccaggaggacataatgtcatccaaggactcttcaatagtctaaaagatttccatcccgattcctccctcgtggggttcgtaaataatggagacggtcttacaaacaataaaagcatagacattactgaagagtttctctccaaattccgaaattccggaggcttcaactgtataggaacaggaaggaaaaaaattgtaactccagaagctaaagaggcttgtctaaagaccgcagaggctctggatctcgacggactagtcattattggcggtgatggctccaatacagcaaccgctattcttgcagagtattttgcaaaacgacgcccaaaaacctctattgtcggagttcctaaaactatagatggggatctacaacacaccttcttggatctgaccttcggatttgatactgcaacaaaattctactcttcaatcattagcaatatttcaagagatgctctttcctgtaaagctcattaccacttcattaaacttatgggacgctcagcatcccatattgctttggaatgtgctctccaaactcatccaaatattgcccttatcggcgaagaaattgccgaaaaaaatctaccactaaaaaccatcatccataaaatctgctccgtaattgcagatagagccgctatggaaaaatactatggcgtcatcctcatcccagaaggcattatcgagttcatcccagaaatcatcaacttaattacagaaatcgaaagcctatcagaatacgaagataaaatctccaggctctctccagaatcccaacgcctactgaaaagcttcccagcacctatcatcgagcaaatcctcaatgaccgcgatgctcacggtaatgtctatgtttctaaaattagtgtcgataaactactcatccacctggtcagcaatcatctccaacaatatttccctaacgtccctttcaatgcgatctcacattttctaggatatgaaggacgctcgggattgcctacaaaattcgataatacctacggctatagcctcggatacggcgccggtattctcgtccgcaatcactgcaacggctatctctctactatagaatccctagcatgccctttcatgaaatggaaattacgggcaattcccgtagtgaaaatgttcacagtaaaacaacaggcagatggaactctacaacctaaaattaaaaaatacctcgtagatataggaagcacggcatttcgtaaatttaagctctataggaaaatttgggccctcgaagactcctaccgattcctagggcctctacaaatagaaactcctccagaaatgcactctgataatttccctcctcttacccttttgcttaatcataacttttggcaacgtcaccagggttgcatagaaatccctgatactacgtattaattacgttctaatacgttcttaattcctgaaaatctaagatgcttccacgcaagcttatccgcatactaaacttagcagaagtaatggatctgattcggatacagtaagactgttacaagccacaactggttcactgaatcctgtacatgccatgcaactcggtacgaatgccacgccatgacgaatcaaagggaaactagatacaaacgtggcaataagaaaagagagcgtcgatcaaccaaggacttttgataagctacctgcctatagaatcctctccccacttaacaaagttttttataaagaaactttcattcttattaataagagataattcaatcgttactatttaaaaataagcaacttagaatcaactatagagagaaaacaattattatattaaaattcatcgaacaacattaggttgaagatggaaacttatagcttttctacagaactacagaaaaatacttctctctatatcatggaaaagttagattcctatttttcctttcaaggcaaacgcacacgggtaattgcaataacccctgcaggtttagccatcgcctacgagcagaatatccacctctctatgaccgtgaaaatattaaaagtcctctcctttccacggtctctcctcaggacaactagtttgtggtatcgcccttgataatacgaatatcgataaacaaaaacaactatccgaagaactcaaagactctcccaaccaacattttgtctatatagaactccaaaatgccttcttctcctataccgagatctaataaagtttcatagacatcgtatcgaagattttgtaatcattcctgcttattctgtgtctttccgcggcgacttcacagtttcttcttcgaacatagaatctaaactatgtttagcggcagcttcatacttcctcataactaaacagccccgttctaacttacttttagcaattgcaaactcaagctctttagtttgttttattcccttttcgagctctagaaggctgaatttctccctaatgaactcctctttagccctagcctgctcttgaaaatctgtggatgtcttacataacaatgtatactcatacagcaacaataagtacctcaatcgtgattgatacaaacaatccttttgatactcctcttgactgggagtcttagaaaaacaaaaaagagaaacatcatgcaattcaataataatgtcgctaagtttcctttgcagatcttgaatcgagcatttctccatcgcatgctcctctctaagaaggctctcattgagctccttggtttctttttcaaaagtgcatagcttcctctttgctatttcaacacaatcattcccccaatccacaaactcttctatcttgcaaagaggccatctaaaatctaacaggtaatatgcattcaaatctcggattgctgtttttagaaaatgtatctccgaagcaatacaaaaagccctccgattcacttttgataaataggcacccaagaattctatagtctgatagatagcacctatgtccccaagacctaaaacatctctggcttttgtcaataaagcattccacgcatcgattgctttttgagactcaaaaagcacatcttcatcttccgtagcctttaaaaatttgtcctggcccagcccgagtaaaacgaattcaagatgatccaaacattgataaagtgaagtgatctcttggtcacttgtcggcttctggtcttttaaatgcgcaaactctcttttaagagcctctaactctactagcatagtgctaatagtagcatgctctttctctctaattgtcttgaaatactctctttctctttcccaaagtttctggtactataataaagattttgcttcctcaactaaaagtccgactcctccagctaataaaagaagtcccagaacaatcccaagaaccccaaaaactaatgaaaggactccatgagaaaatactgtgagtatggcaaccccagcaagaagaaaaagagaacctataataactaagctcacagctaagatcacaaaagtactttgtttaaagcacctcttctgttgtatctggtcagaagtcttatgaagcaaagcagattgaatagaagaggcctgtacattggaaatatcaggataagacataacacattctcaacaaaacttatgggaaaagaataaaatcttctttaaggcattttatttttaagcaatgccttataaaaagaaatgttataactttgaatggcttaaaaaataaaatatttatttgtttatgcctctagaaggatatccacataaagttgagcaatctcgagttctaaagtctttgtatgtactacgcacatttgtagctcttcaaaggtctcaatacaatcctccacagccatccgagcccttaccctgtcaagagtatctattggtttcctagatactacctcatcgttgtatatcgcccataaagcatgtaacatagtcacacgtatacagtggatttggtattcttccaaaacatcctcagaatcactcgtaaaaagattcgtttcattttctaagtctgtttcaatctcagtacaacaacacagaagttctgaaaccgatagctgttttgctcttttcttttcttcattcactctcatatcttccacacagacttttacataattacgcaaattttttgctgtgcggcacatagcatatgcttccataagaaaatggggagcagttccctcaaaaacatcaccaatataaagattactcagtgctttctttgaaacatgaatttctgaatagcaccaaaggtcttctctgtaggatctccaaaaagcagctttcctatcatagagcttcttgaagatctcctgagcagattttcttcgaaataatagtgcctctttacactgctctaaaatagagttttgctcttgggctctctcctgaatttcacttagatttcgaggaacacctatctttagaatctgttttttctctgttttagaaccttccaaaacatcgagtcgtgcagaaaacccacgaatcaatgtatcctttttctgctctaagtccaactcccttgctaaatcagcaatctgatcctgcatctgtataatctcactaggaagcttcttatcgaaccctccctcaacaccaaatagctctttaggctctaatccatagcgctccttaaatttaagaagcgccaatcctatacttattaagagcagccctaaaatcatgctgctcatccctaaaaggtacgtagagaaaactcccaagaataccatccccaggcatacgaaaagagtccctaaaataataagacaaacgatcacgacattaaagacgtggtgaatgcgaatactcgccgtttctataggcccaaaagggaaaagactgtgtttacaagaagtaagttctgaaaaacttaatatctccgaataaatagacacaaccactccatacgacagctctcagagagattttataaaataatttctcagttttaatatttttttacaaaccgttcttctaattcaataattcttgaaattcgcctcttgaagtatgttgtaatactatttgatattaaggatgataaacgtaccctcaactctcgaaaacagaaaacagaaaggatcgttctctttcttccacaaaggaaggataagctctaatctgggaattcctatctgattggtattagaaaaaattaccctagagaaaactaccaaaatctataaaccttgaatgtgtagaactgctaagagaggcaactatggtcatcatagtttagaaacgctctcttctgtgctttagtaggagatctgtaaactaagtttcttctgtcactatatcttttatcttatggatcagttctagttccaatgactttattacgtcttgaagtgatcgtaactctttttcaatctctgtgagtttttcaaaatacgcagattttatagcacctctgaactggagcttacgcaccagaagggcgttcaacccagtagaagccgccctcattcgattttcacattcttcaagagttaggccagaagttactgttccagaaataaggaactcataatgatgcagaactatttcgctatttaaataattcaaaattaaaagctgttgatacggactaaaaagttcaggatgggaaagattttcaggatctagcccctgatttttaagggcttcttcattttttttcatttctaagagagactcagttctacccatgaaaagacgtgccggactttctttcttggctctatccataagcttttttgttgccctatcgacaatatcaaaagctttctctacttctttaaattccctactcatttcattaatgaacttcttacgttcctgagctttcacatcaagcttatctaatctagaggttaatcttataaacagacctttgatagcctcaatttcatcataatctaccttgagtatacctggggggagcagaaaaaaatttaatagaacttggaggtctttcctaagcctatacaattctaaatataatgaagacttttcctcatgcaaatcaaaaatattgctttggatccctttaacctgttctccaaaagtggtaaaatttcttctggtttctaaaaatctatctcgaacaataagaaatttagtcacttcgtcttctaaagttagccatttctccatgcaattgataaatttaccctgaagctcttggcttagatcagagaaatctttcgtatggaactgaaacagattttgcaacttttcaaatgttacccgcaactcagagatgtcattggggatctctttcttatgaatcaccaaagaatctaaatcttgatcataataatctaaatcttgacgagtcttgtgtttgtgacataagaaaacaataagagctacagccaataaaacaagacctatgcaaagtatgggaagcgccgctcctaaaagaactccgcaagacgtatgaacaaggaatgcaagagaaccagataaaaagaaaatcccaaggataaataaagcgacaaccaccacagtagaaacgtgcgaagcaatacatcctttagaatctacacgttgaggatgtggagcaggaggtatgttacaataggtgggacgctcatagtcttcctttaatccaagaaatcatcgtgagcatcttcaaacacactatcattaccatctaatgattcgctctcactcaacaaatccgtcgtagatgcaacaaatgccacatttgctctgacttgatccaatttaactctaagagtcttgcgaatacgtgcttttaaggcctcatactcctctaagactttctcttgttccgaagagaaagtttgagttaaaaactgctcaacaatacgacattgaacttcataaaggcgcaataaatgatactgaataagagttggttcacaactcagatcttctactaccgatttcctgacttgaatatcaagaagttctgctttagctttatctagtgcttcttgcagctcttcttcagaaaagacggttctgtgtaaagatgctaatttttcttcaaatgcactcacaacttcttcgaaaagttgaatctctttttcaacggaaagccttgtttttaggacttctaatagttccctcctataaccttcgggaaacacctccagtttctctactttccttttgtctcgataacattcctgttctatctttacgtcttttaaagcagatttaaacttagtcaactcacaagcaagcttcaatccagatttccctactttcatgacttcttttcgaagcttatctatttcacattgaaggcgatctccttttttccttaaaaattcaagaggcccccagatattctttaactcagtaagtaacgctacatcccttccgtctagttccttccaaatcgtctcgtatttttcgacttcacgtccaaacagaagaagatccccctcaaatgtagcgaactgactcttatgttgagcgacaacctctttaaagtcctcccactcatctaatagaaaattgctccattcctgaacttcattaagctcttttctaagatctgcccacggttgatattctaaagtaattttttgttctaatgatctcgtggcttctgaaagtttccggtgataagagacaaagaaaatcagccccaaaatcaagagtaaacttcctaagaaaacacctgcgcccccgagtcctacagtcaagacagaaaaactaaaaatagcatttacaagcaagagcatccccacacataacaggagaacacccaagacaatcaaagatacagaaaggatcagagacttatatttaggtggatgaactcctaaagttgaagagggttggggggacggagacgggaaacaatcacgggcaatagcgctagacataacttgctttttacttgaagttaactacttaatttccatacacttatatgaatgaagtttctttttgtcaacaaaccagtaatacaaacattttaataaaaatttataatatttgtattaaaaccaaataaatcaataaacaatagccccgtttattaaacaaagacactatcgctataacgaaatttctccgctatcctcagcttttcttcaataattcctagacgctcagaaatcgcactcatgtctctctcagattcaagatcctctttatataagggagtttcatattgaggaacctctttttcaagatagagagaaagtacatcaggaacacgtttctcttgagataagagcaaaatcaggctaaaagagaaaagaaaaagagcaaaaatcaagcagccgagtcctagagtaaaagcagcccccgcagaaagtccaaccagacctatatccaaacaaatgacagataaaatggataagacaactccaagaataagtaagccccccgccactatataggagttgattctcaaagaagtgtcttcaggaataaaatcaacttgaatacgatcaaatgtcacaggattcatggtgcgtgccttgttctagatttttcgcaccaaagatgttatcaattatttattttaaatagcatgcaaaataatacaattttgatttgatgctatcccctaagacatatccacgaaactctttaaccatgcacgcacaagcttcatatagcgttgtgcgatttacacctcgagacatctatgactgggaaggatttccaagcatcatctacaaataaaatcctacatatcttaaactaaaacgaaatgtatctgatctatgatttcactaaccaaaatgctgcaaattgaaaggatttttatctgtgaatgaattaatttttggattccagactttctctgttgtagttttaggagttttctttgcctctagaggaaaggcttggcttacaggatggctatcgctgctctcaagcatcatgaatgtctttgttctaaaacaaatccatctctggggttttgaagttacgtctgctgatgtctatgtgattggtttgcttacttgtctaaattatgcccgagagcactacgaaaaaaacgatatcaatgatgctatgctatgctcctgggtcatctccatagcgtttttggttctcacccagctacacctatttttaatcccctcacctaacgactcttctcaagagcatttcttagctcttttttcttctactccaagaatcgtagtagcctctctggtcactttaattttcgttcagatcgtggatataaaactctttaccttccttcaacgagttttttcaaagaaatattttgcaatgcgctcaacaatttccctgctcttttctcaactcattgataccataatattttcatttttaggattgtatggattggtcagcaatctttgtgacgttatgatctttgcaatgctagtcaaaggcattgtaattacactagctataccgactctaacagtaactaaagccgttttagatcgtcgttcctcttaagctaagaaattaacagcttcacctataccctctaacatcctttcggtaaaggagaggttctgcacacaagtaaaggttgaattacaatagagaagtaggcttagaattattgcgacaaggaaagcaaggaagcaccctataatatcaaagacaagaatcagaacccctaaacctaaaatctcaataacagcttgaagcacctcgaatctgtacttcattttatctctaggatggatcggccctgaatgcgcttctatcaatcgaatgattccaccaatggtagaaatgataggaaggctacgatatagcctatggtgtattggagtcttcttaaagtcatgaatacgataaggagtctctttaagttctgaatcaacaaaataccttccctggaccaaagctcttaaagacttaggccaggaggaagctacatttgcaaaatcttcataagattcgaaaaacacttttttagacaaaaaaatttaaaaacaaaacaaatatgcgttattattcattaaaataaaagttttaaaaagattaattttcttaaaacaaaatatccccaataaaatattgtacctaccagcgcctatccgtattaagacccaggaattcagaaagctcctttggagtaaaagaccctactttaaatctaagaaatcccaagctagggtcagataaaacaaaccctatttacttaaaaattttgtcattgtaaacttcctcttccctaaaagacacatccaccttgttctttatagttaaggatctagtttggcactcaaattccatctcatccatcaatctaagaaatcccaagctagggtcggacaaatagagaccagccatggagtgatcgatacacccgcatttgtccccgtagcaactcacggagctttaaaaggagtgattgatcacagcgatattcctctgctcttctgtaatacctaccaccttcttcttcatccaggcccagaagcagtagctaaacttggggggctgcaccagtttatgggacgtcaagcaccaatcattacagattccgggggatttcaaatttttagcctagcctatggttctgtagctgaagaaatcaaaagttgtggcaaaaaaaaaggcatgtcctctctagttaaaattactgatgaaggtgcatggttcaaatcctatagagacgggagaaagctattcctctctccagaactctcagtacaagcccaaaaagatctcggagctgatattattatccctctagacgagcttctccccttccatacagaccaagaatacttcttaacttcgtgttcccgtacgtatgtctgggaaaaacgttctttagaatatcatcgaaaggatcctagacaccaatccatgtatggggtaatccacggaggcctcgatccagaacaacgtcgtattggcgttcgttttgttgaggatgagccattcgatggctctgctatcggaggcagcctaggaagaaaccttcaagaaatgtctgaagtggttaaaatcaccacttcatttctatcaaaagaacgtcccgtacacctattaggaatcggcgatcttccctccatatacgctatggtcggctttggcatagactctttcgacagttcttacccgactaaagctgcccgtcatggtcttatcttatcaaaagcaggacccatcaaaatcggtcagcaaaaatatagtcaggactcttccactatagacccctcgtgctcttgtttgacctgcttgtcaggaatctctagggcatacctgagacacctttttaaagtaagagaacctaacgctgctatctgggcttctatacataatctacatcacatgcaacaagtgatgaaagagattcgtgaagccatcttaaaagatgaaatctaagtctcctttctaaagattccacatctaaaaaactctaatttttccatttattttcaaaaaaatctgtaaagatttctttatttagatcacaaaacactctcttatttataagaataaaaaaaattaatttttattaaaaaataattaatttatcggattttaaaccaactttttataaaattgattctatagttttttaaaaaaaaagggaattttttatatgtcgaaggaaagcattagaagttattctgaaatttctactccaacgccgatattcagagaaacgccctcgaaagaaggcgtggcatataaacttcagcttagatcaccagctaaagactgcatactcaggaatagagtatctctaaaaggagctctattaagatccattccattttacggatcattcttaggtgctaaaagaatccatagtgcctggtctgcaaaagatgccccctgcacaactagagtgtatcactacctagtcggtgggcttgagttattgggactcggggttgttgttctagcgtgtaaagtactcgccaccgctctaaagtttttattctctaaagcctcctcgaagataaaacaaatgaaatggcgagagaaagcgcgcaacctagcagccaaagatacggtacaatcaataaaagagttctgttccgttgatcttacatcttgctttacaagatgtttcaggcttcgaaatagagtggtagaggaaggtgcatctgaaaaccaaacagtaagagagatcattgtataatctcatagttttctatgtattcttaaacaaggatatacgcctataaaatcgcaagaaaactttctcatacttcaataaagaaacgaagtacctatacgtagcagctactaagaaaaaaggaatccccacttctcttagtagctgctattattataaaagacgtaatttaataacgtagaccgcctaaccccatagcattgtcttccctcccacaatagcgcacagaatccgaaaattataaaagtcttaattatgaagaattttaaataaatgattgaaaaactcgtactatttcaaagatcttagcattttataaaacaagcgctatcttcataatccgctttatataaacattttattttatctaaaattagattaggatgcactacgttacaagtatgaaataggcatccaaatggtaaacagatacaagagctctgcagaattttccgctgatcattactatgatgacaacctggttcggatggggtataaaagaaacttaagaggactagctcctgtggagaatgaagtctgtctttttgaggagaataacctactcgaatctgtcatggcgtctataccaattatgggatcgatacttggcttaggcagacttcatagtgtttggtctacacaggaccctaaagatagtaaaatctctataattttccatactgcacttggaattctagaaaccctaggtctaggaatcattgttctccttattaaaataacgattactattctccttattctatttactccatgtcttctctgttatttcatgtattctgctgcttatagtgattttcatcctatttagttaggttctaacattctctatttaaaaaaggctttgaatgttccttgacaagtagacgagcaacctaaagtttccttcggagaatcacgagtttttcttcaggttacatctcagttttagaggaaactaagacgtagaacgtttgtgttgcgaatccatcttaatcatgaatgattctcatatggcacaagcagttctccaagctctctaccagtaagaagtggggtataggagctttggctaccgtaggctccaatctcacacacgatccttcggacaacttgtaaaactcggcatactagcattagggtctgaaacatcctggcatagaaagcttctctctcgcatggaaacaagtcgtttcagaattcatgattctagctgttttatcgagccaattctgtaaggtgaaaagtttttaaaaccttgggagaagttgcgagaattaaatgcttttgaattaactcaacctgaagagtatcgaaaccgttgggttttgatgccttgtcttaagtgtcgtttttgtagaacgcaacatgcaaaagtctggtcttatcgttgtgtccatgaagcttctttgtatgagaaaaattgttttcttactttgacttatgatgataagcatttacctcagtatggttcgttggtaaagctgcatttacagctgtttcttaagagattaagaaagatgatttctcctcataaaattcgttattttgaatgtggtgcgtatggaaccaaattacaaagacctcattatcatctacttttatcatgacataaagatttttttaaaaatcttaaaaagaaatgacctaaggactgttaattatatggaatttttattacgagtttcattaaaatgttcggctaaaaagttaaagtacgatgctaataggcagatacagtagtgatgaccaattcactgaagcaacaaaaaacaccccaaccataattaagctaggttttgttagagataatctcgagggattaacgaaccctatctctgaaatcgtctcggaaacctcctcttctattaaagattccgttcttcgctctcttcctattttagggtccattttaggatgcgcccgactttacagcacactctctacaaatgatcctcttgacgaaactcaagaaaagatttggcacactatatttggagccttagaaaccttaggcttagggattctcatcctcttatttaaaattatttttgttatattacactgcatatttcatctagttattgggttctgcaaataacaacaattaatccacgcctacggcgtaattaaattgtatctttttagaaaaagacaagcgtataatatacatttaaaaatcctaaaaaaaataagaaaatgaagccaaatagtattatttttttagaaaatactaagcattatcccgacatctttcgagaaggatttgttcgtgatcgtcatggactaatggaagcctcggattggttactttctacggaaattacgatcattcgctccattctgggagctatccctattttaggaaatattcttggagccggacgactctatagcgtttggtatacaagtgacgaagattggaaaaaacaagtggtttgacacacgatatttggaatcctagaagttcttggccttgggattcttgctttagcattaaagattctcctaaccaccatttattacttgctacgaggcctctggaacgtttcctttatgcttatagagatcttttccgcactggtccctaattatccagtacttgtttaaaactctttcacaataaaatttttacttatgactaaaaatgctataaattcacaaacaacaaccccacaacccaatttaacagacgcagaacctatcgctagccgtgcgcaatgtaaatcaatagcggtaatcattagtttgtttgctctgggaatgctcctactctgtctggggataattcttatttccatacctattcctggacttgctgcacaagttgctctcggcctcggaatagtaagtttaatcttaggaattgctttagccaacataggtttcctatgtttattacttagatgcaagcaggttccccaaaaacccgatacattgccctctgaaagctctaaacagccttccgagggaagcactcccaccgcactcccatggcaagctggagaatttttagaaaaagtacaagtatctgcaacccctatactccttcccaagaacaaagatgaagagttatcagcaaaagttatgaaagaaggagccgaagcagcttcttcaattaaacaagctgttctagaatctacagagaaattaatcgatgctagaaaacaagaggagagccgacgagaggctaggaaaaaaatcgtggcggaggaggctgaagcatctagaaaacgtattcaacagcaaatggcagccgaccaagaagcgttaagaaaacgaaaagaagaagtagctaaaagaaagtaagctatttttaatagaaaaagaatgccatactatgcaaacaccctggagttcatccagggaactcaaagtctatgtcctttattcaaatatgggtttgtaagacaccattataaaggacaactagaaatcgaagatgcttctcacgactgggatttcttagaacccccttctacatggaaacgcactctccttgctgcaattcctattctaggatccgtcataggtctaggaagactctttagcatctggtccattagagaaccccaggactctcaagaatacaagtctatattctggcacactctatgtgctgtcctagaaattttaggactcgggattgtagctcttattctaaagatcttagcaacctttattatggcaatgccaggtttaaagagagttgcaactttcctattttattcttaagagttacaaattctttaggcctagaatcgtctaccctatcctctatatttttttgtaagaactaagagacatacaatggcaccgaaagcaacaacagacgccatagggatcgtcacgtagctaaaaagaaagatctttgttgagcaggagactctaccgcagatatccaattgcatccctggaatttcttgcaagaaaacttggtagatagaaatccctaagcctaggactgcctgaggaaggatatacagtttgattgaagagtcctcgcgataagctgaaattcctaaaattacagtgagtgggaacagacagattctctgatagtagcaaagaatacaaggctctacgttaagaatatagctataaaaaatgctaatcaaagtgccagcacaagaaatagcccaagcaaaatataaagcatagctacggataaaattaatcatcatgatctccttcaacagcttgcagctgacgaatatgttgaatcgctctttctatttcatgaaacgtaggatcttcgattaagtagtctccgactacagccgttggtgttgctaactgtcctcctaaaacctgagacccgtatagattattcttcttaatctgctcgttatactgtcctgaagcgatacactgttccaagcctttaggattaacactacgtccagaatttatttttaaaccctcagccaactttgtaagaacctcaggagttgcccagtgtgagccttcctctttaggataagtcaaaatacgatggaaatattccatataagcgtctatatctgcctgacgtggatcgtgatgataaatacatagcaatgcttgagctgcaggtttagacccgcgaataaagcagacaggaatcaaagtaaaagaaatctctccagtatcaatatagtgcttctttaacaaggggaacacttcagtagtgaattctgcacaagcagaacaagaaggctcctcaaatactgttatgtttataggagcataaggattccctatggtaggaaagtgttttgcatttgtaggaatatgagctttagggggtagaatcgtatgttttttatgtattagaaagccaaagcaaacgataaaaaacatcgcagtgcacagaactaggatctttttattcaaaggacctcgtaaagatgaatttgttaattgcttaatagaacaaaaaacataaaattcaaaagcattttcttttttgagaattgaacaggaaaacttttcctttaagtttaagaaatccgctctatcttttacctataacaccgcaaatctcactaaaagtactttcacttttattctactgcttttattaaggaaaaaagatcagggcctaagatttatggataaagaaacactagaaaatatctatcgacattttcgataccgttttttaaaactcaatatcctccctgcatttcttggtctccttcttctatgttctccaaataccctaaattatacacaagtcgatgtcatcttctctgatcgtctttgtagttgtttacttattttcttagctattgcttccctaaccaaacgttctcttctctggttaggagccccactaggcatctgggttacccttttcgcctgcgttgcaggacgatctcctactatttttgcaaatgatactctaattggattcgcaattcttgccgtagtgtgtatttcccctacacgacccgaagcccttgaagtaggcccgacattacctgaaggtttttcttacaatccttctgcaggaggacgcagagctgcagtactattcctaagcttactggggtggctagaagctcggtatcttactgcttccagcttgggaattacatcgagtcagtcttcgaacttcttactattgtactcatctataatgactgtatactctctgctcgtggttctctctctagcaggaagtgagcgccgctggcacacaagaccaaaaatcgtaatagcgacagccttagctttaacaggcgtcattattttaactcttctccctatcatcctacaccaactgcgctatgattgctggctatgcctttgcctaactatagaacctgctcttgccgtggtctttgcttacgatgaaaccagggccactttgcgctatatttctcaatttttaggagataaacgagctcttactagagcctcgttctttggatcagaatactataaacacactctgtcttgggaagaaagaacagtacttcctctacgaaaggcatataaacaggcatttgaggggatctccttcccaatcaaccagttattggctatcctagttgctactgtttttgtaaaagtcaatagcagtatgggccttcctacctttcctaggaatttcctcaatatatgttgttggtttattatcgtcctgttcatcttagcttttgcagaaagccttcgtcatttgcgttggatgaatctgatcttctctgcagcgattttattctctccagtactctttcatattcccgtagaatctcccatgttcttgccgatcatcgttacaggactcattctaattattctatctataggaaagagacgaagaactaaacgcaaactctaaaagagaagcttacgtgcctaacccctcccataagggattggtttttgaggcgttttttgcttctttcttagcttcgcgttcgtcacgcttttctctttggttcttgttcatgtagatattctccttagcacgctctaaagctttttgtatcagctcatcatgttttaaagattcaggagaatccttttttggaatgattttaagcgtcttacctaagatcatagaagagaatcttttgctatactcaggtactagcacctgagattctatgtagagagaaagagctttcttattaggagttttcttttctttttcacagtggtcatagatttctttgtaattgctctgtgtaatcctctcatggagagccaacacttgcttatggtgggaataagcatagatattcaaaggcaaaacaagaagaacaaaaacgagaatcgagggtaatagccagggaagaatcacatcataaagaatagatgcaccttccagaggagcacccaaaagtatagatcctaaaacaaaaccaaaaatacaaaacatgagaagtgctgctgctaaaattatagcaggagccccatgccaaatatgattaaaggctttcttgtagcaagctactttctcctccccagtaagtacaacataacggcttaaagaagaggaagtggtgaccagaggctgtgaactcatgtatataagtgcttttttaaatctttaatgaaacatagcccattatttaaaggtctcattgaaggatccagaggaacaggagtgagtgttttgttcttaataacgtacaagacatcccctaaacaggaaacgtcatgaaagtcgtgagtgacaagaagcaccgtcttattttccttctttgctaaagcaacaatatcttggtagagctgttctttaagcaatacgtccaaagacgaaaaaggttcatctaaaaggagaataggctttaaagacaagcactgagctgcaagagcgatgcgctgcctttgccctccagaaagttcgtctggataacgatcaagaagctgtccgagatcaaaattgtgtataatctcttcaaggcgttcattggataaggcgttgtgacttgtattgatgccaagctccgttgacaacgtcatgttttttaaagccgtacgccaaggaagcagggcttctttttgctgcatataggcaacgtctttgcgatttagagggctcccattccatagaagttcgccttcttgcaaaggtaggaaacccgcaagcaaacgaaacaaagttgtctttccaactccagaacttcctaaaataatcgtaattgtccctggagacgcttggaaagaagcatcctttaaaatgacttgattgtcacaagaatagcatagacgatgagcttgtaacatggaaaagcctctatcttgaatagaaacgaaggcttgcggttaccaagacttgaacttgggacctcgacattatcagtgtcgcgctctaaccaactgagctataaccgcgatttggagactaggagattcgaactcctgaccttctgaatgcaaatcagacgctctaccaactaagctaagtccccggccatcccaataagggaaaagtaaagaatcatcttacctatcaagagatttaagctcaacaaagaaagtataggaaaatctcaccttaatgagaagaacagagttcttttaatacactcttgagcaaggtatccatataaattttacttgcctcactttgaagatgcttccaatcctcgttactccgtgattctaaaggatgagggagaaggatattcacacctaaacaaggaatgctatattcatagcatacctgagaaacagcgccgctgacactatcaaaaccatgaatctctggatacaatttttgtaaggaaagaaaatagtttcgcgacatcgcgaaagactcgcctgtagcaaccaaaccttccattaaggtgtgctccgttttggttgttgatttcaaatacccatgagtcttcaaaagctcttcgatttcttgtttatgggtagaaataaactcttcgcctccacgaagaattgcctcccgatgaacctcactggttgcaaaaacactctttttaatgtctggaatctcaaatctttcaaagaaaggcctcacatctgcatcataattaatgtagcctttagaaactaagacgctgccaaaacggctatcttgagacctagagtaacacgagcctataattagaataagatccactcgatgtttaagaatcatattacaagccacaacagctgaagaaactttattaggccaaagagcagaaactacaaagtatttcccaaaggagtcgccagagtaataaattctctgtccctctagagtctttttactatgagaaaaccaaggaataggacaattaccatcaaaagaaacgggagtaaccccaggtaaagcaaaaataatacttacacgacttaaaggactctgtttttcttctagaatagtgaaattatcagcagagaatgcgaccaaaggaagagagctaagaataagaaacagaaaacgacgcataagaaatttcttctaagttaaagatactgttttcgcattgtataagaaaaagatctgttaaatagaattaaaaaacgaaagtacgcttctttttaagctctagatactcccttaaactcttcttaactctgtcctttgttctttaatgacacatccatttctactactataaaagtactgacaaaagcacagagtacgattttcaaatcgggagtctcaagatgaaagaagatcccaatctcttgaacgtaagaccttcgagaaattcttagcaaaaagagaagaactttgcccaaaaacatagtccttgctttttctcaagaattagagctttcagatgcctagtatattgagaatataaataaaaaaaccattgccaacccggcaatggttcttaaaacacaaatccaaaatatagaatcttacagactcactttctttttcactgaagaaggaatcgttcttggttctcgtattttagtaattttaaaagactgagaaaacgcctcgtattctttatccaaggcctgaggattcttattcttataaaccataaagacttgataaagagtgtgatttacggaaatcaacatccctctgaaataaacatcttcgcaaacaatccaaaattccaaagccttatggccttgaatctgccttgcttgcatgaaaagaacctgggattcagggagagcctgcatcatgcctgaaaacccctcttgcagattgagctctggacgacttatatctactttttcaggatactcccaaacagagactacatacacagtgttgtctggatgagtctctgttacataggtatcataacgtatggtaatctctgattgagggacttctacaatttgccccgaatgatcaggctccccaggaaattccacagaaaacccagaacttgatgtatagtcatagcgtttccatgaaagactgtctttaactggtaaaattctagcctcttcctgaatctctttttttgagaaccatcctttgactttccctaaaaaaccagatttagcttcgactcccataccagggatagggtgaaaagctaaaatcgatactactatggataataaggcctttttgcaactctgcaacataataaactaaaaaacaaaacaagataactaacttaataatatcccttcgagatttttattttgtaaaataaaatacttttttttcagaaaaataaaaaaaatattgcgttttataaaatgcatcacaataatcctggtagtcttaaacacataagtttttgttaggtatctccttatgaagccggaagagtctgagtgtctgtgtattggagttttgcccgcacgctggaatagcagtcgctatccaggaaagcctttggctaaaattcatggaaaaagcttaatacaaagaacttatgagaatgcttcccaaagttctctattagataaaattgttgttgctactgacgatcagcatattatcgaccacgtgactgattttggtggttatgcagtgatgacttctcctacatgttccaatggtacagaacgcacaggtgaagtagctagaaagtacttccctaaagctgagattattgtaaatattcaaggtgatgagccttgtctaaattctgaggttgtcgacgctttggttcagaagttgagaagttctcctgaagcagaactggtgactcctgtggcactcacgacagatcgtgaagagatcttaacagaaaaaaaagtaaaatgtgtttttgactctgagggaagggctctgtattttagtcgcagtcctattccttttattcttaaaaaagcaaccccggtatatctccatattggagtatatgcttttaaaagagaggctcttttccgctacctacagcatagctcaactcctctaagcgatgccgaagatcttgagcaattacgtttcctagaacatggaggcaagatccatgtgtgtatcgtagatgcaaaaagtccctctgttgattatccagaagacatagctaaagtagaacaatatatcacatgcctttcaaatgcatatttttaacaggaggagttgtctcctctttaggaaaagggttaacagcagcatccctagccctaattttagaacgtcaacggcttaacgttgctatgttaaaattggatccatatctaaatgtagatccaggaactatgaatccctttgagcatggagaaatctatgttacagatgatggggttgagacagatcttgatctcggtcactatcatagattctcttctgctgcactttctagacattcaagtgccacttcaggtcaaatttatgctcgtgtcattaaaagagagcgtgagggtgattatctaggaagcacggtacaagtcatcccacacattaccaatgaaatcattcaagtcattttagacgcagctaaagagcactctccagatgttcttattgtcgagattggagggaccataggagatattgaatctcttcccttcctagaagcaattcgacaatttcggtatgaccattccgaagattgtctaaatattcatatgacttatgtcccctatttacaggctgctgacgaagttaaaagtaagccaacgcaacactccgtacaaactctacgtggtattggcatcattcccgacgcgattctatgtcgttctgaaaaacctttaactcaagaagttaaatctaaaatcagtctcttttgcaatgttcccaaccgggcagtgtttaacgttatagatgtaaaacataccatttatgaaatgcctttgatgcttgctcaagagaaaattgccaatttcataggggaaaagttaaagttagctacggttccagaaaatcttgatgactggaaggtactggtaaatcagctatctcaagatcttccgaaggtaaaaattggagtcgttgggaagtatgttcaacaccgagatgcctataagtccatattcgaagcactcactcatgcagctttaagattaggtcatgctgctgaaattatccctattgatgctgaagatgaaaatcttactatggaactctctcaatgcgacgcatgtttagttcctggaggcttcggcgttcgtggttgggaaggaaaaatcgctgcagctaaattctgtcgagaacaaggcattccttattttggtatttgcctaggaatgcaagtgcttgttgtagagtatgctcgcaatgtcttaaatctggatcaggcaaattccctagaaatggaccccaacacccctcatcctattgtatatgtcatggaggggcaagatcccttagtagctacgggaggcaccatgcgcttaggagcgtatccttgtctattaaagccagggagcaaagcccataaagcatataacgaatcttctctgattcaggagcgccaccgccatcgctatgaagtaaatccggattacatacagagtttagaagaccacggcttacggatcgttgggacttgtcctccacaagggctttgtgaaattattgaagtttcggatcatccttggatgattggtgtgcaattccatccagaatttgtatctaaactcatctctccccatcctctatttatcgcatttatagaagcagctctagtctattctaaggatgcaagccatgtctaagccatctagttgcaaagcataccttggcatagactacgggaaaaaacggatcggccttgcctatgcagccgaacccctcctattgacactaccgattggaaatatagaagcaggtaaaaatcttaagttgtcagcagaagctcttcataagattattttaagtagaaatataacttgtgtagttctagggaatccccttcctatgcaaaaaggtctttactcatctctgcaagaggaagtttccttacttgctgaggagcttaagaagctttctacggtagaaatcatcctatgggatgaacggctttcttcagtacaagcggaacgtatgttaaagcaagattgtggactaagcagaaaagatcggaaaggaaaaacagattccctggctgcaacattaatcttaacaagttttctagatagcttacctaaaaaactaaccttgtaatcatcaaaaactacgggattttaattttagaaactttttactttttgttattttcgcaagtgcggggacaaaaaaggagataaaaatgacgaatgttgttcaggaaactataggtggattgaattccccacgaacgtgccctccttgtattttagttatctttggagcgactggagatctgacggcaaggaaacttttacccgctctatatcacctcactaaagaaggacgcctttcagaccagtttgtttgcgtaggatttgcacgtcgagagaaatcgaatgaactgttccgccaagagatgaaacaagctgtcatacaattttctccttccgaattagatattaaggtatgggaagatttccaacagcgcctcttttatcatcgctcagaattcgataacaatatgggatatacatctctcaaggactccttagaagatttagataaaacgtacggaacacgtggaaatcgtcttttttatctttctactcccccccaatatttttctagaatcattgaaaatttaaataaacataagcttttctataaaaatcaagaccaagggaaaccctggtcccgtgtcattatagaaaaaccttttggaagagacttagatagtgctaagcaacttcagcaatgtatcaatgagaatcttaatgaaaattcggtctatcatatagatcactatttagggaaagaaacggttcaaaacatcttaacaacacgtttcgccaatacgattttcgaatcgtgttggaattcacaatatatcgatcatgtccaaatcagtttgagtgaaacgattggcataggatctcgcggcaatttctttgagaaatctgggatgcttcgggatatggtacagaaccatatgatgcagctactctgtttactcactatggagcctcctacaacttttgatgctgatgaaatcagaaaagaaaaaatcaaaattcttcaacgtatctcaccattttcagaaggttcttcgattgtccgaggacaatatggtccaggaacggttcaaggagtctcggtccttggctatcgtgaagaagagaatgttgacaaagattcccgagtagagacctacgtagctttaaaaacagtcattaataatccccgttggcttggagttcctttctatttacgtgcaggaaaacgactcgccaaaaaatctacagacatttctattatttttaaaaaatcaccctacaatttatttgcagccgaagaatgttcacgttgtccgatagaaaatgatttgctaatcatcagaattcaaccggacgaaggtgtcgctttgaaattcaactgtaaggttccaggaactaataatattgtccgtcctgttaagatggacttccgttacgacagctatttccaaactacaactccagaagcatacgagcgtttattatgtgattgcattataggggatcgtacgttatttactggtggagatgaagttatggcttcttggaagctttttactcctgtattagaggagtgggaccaagattcctcaccctcgtttccaaactatcctgcaggatcttcaggtcctaaagaagctgatgctctcattgaaagagacggaagaagctggagacctttatagacaatcttatacagcatctagaaatcgataagcatgacaaacatagggattgagactatggcaacactgataaatttcaatgatacgaacaaacttttgcttacaaagcaaccttctctatttatagatctagctagtaaagattggatagcttctgcgaaccaggcaattaagcaacggggagcattttatgtagcattatctggaggcaaaactcctttagaaatctataaagatatcgttatcaataaagacaaacttatagatcctagtaagatttttctattttggggagatgaaagactagctccgataacatcgtcagaaagtaattacggccaggctatgagcattctccgtgatttgaatattcctgatgagcagatctttcgaatggaaacagaaaatcccgatggagcgaaaaaataccaagaacttatagaaaataaaattcctgatgctagctttgatatgattatgttaggactaggagaagatggtcacaccctttctcttttttccaatacctcggctttggaggaggaaaatgaccttgtggtctttaattctgttccacatctagaaacagaaagaatgaccttaacctttccttgcgtacataaaggcaagcatgttgttgtttatgttcagggggaaaataaaaagcctatccttaaaagtgtcttcttttctgaaggtagagaagaaaaactctatcctatagagcgtgtaggtagggaccgctcacctctattttggattatttctccagaatcttatgatatagcagacttcgataatatctcttcgatatataaaatggacatcctctaaaaaagataggcgttgcgatttagccgtagatagtatcgtaagccggcggtggaaaaggaggaggagcactaggcatggtaggagccgtagggtatcctgctccaaaatgggatcctgcaaagccccctcccccaccaaagtgacttcctccaaaattaccgtttcctcctcttctattctgataatcagaggagcctccataatgctgagatggtcgagaacctccaccaggagctcctccttgaactaactgagcaacttcttcgttagagaagaggtgtccataatgagacagacagtctgtgagaaataggtctcttgccaatgcatttgtttggaaatgagagggatcatgtagcagagcctcactaacggcagtatgcaaaacaacattcgttaggtgacccacgcatgcctcttggtgctttgccttacgaactatagcaatccatagtcctagcagagaaattaacagagcgcctccacctgcagcgcagcaccccatcattgccgcagtaattacgggagcagctccaggagctacaaaaaataatactaagacaatgccagctgttaaggctattaaagctaaagaagctattaagctaacgactaaggaccctatcatagcactcttatacaacttacacgcttttacagcctcttctgatgaccttatggttgcaacacctgcagctcgatggaagacattttgagcaggatgacgtaatacttttgccttcgccttattcagagagtaaatcatcttcccaagcgtataaactttataagcacaataaaccagggcacctaatgtcggtcctaggataagagcaactacgaagaaaagtagtgtagctcctaaaacgatcgctgatgtctctttttctggagtttgacagctcttacattgcgaaaagcacataatcaatattccgaagctattgaacaaattccccaaattctgcgcagctttaaaccctgtcatcatcatgtcggttggtctatcaaatagagattcaatatcaggaactcgtcccttcatgatctcactaaacattacttctgtactctcggaaggagatacaaatttgttttctagaaaataacagaagttactgcgcaccactgaattagctttaacaacagattctgaggaaggggaaaacaccataaaataaaccaattactaacaatacattacttactaacgataagtatttagctaagggctctcagccttaagtaagttctttgtttattaacagaagtattttatcttaatgatttaaaaacttcaactctcgagactgattttagaatcgtatttaaaataatttaagaattttaataaccgattgtttgaacgaaaaacttaaaaacttaaaaatttaaatttataatttagataaaaattaaaaactacagcttgcctattgctaaaataaataattcataaacacaatgcgaaacttcgttataaaaagcacatgcaatctagtcttaaaacggtgattataaaaattagcgataataaggaggaggagaagaagagggaaaaggagaattcgacgagtctatcgtagaataggccggtggagattctctaggaatcacgttgctgctaccatcgctcccctcctcatgaaacagagtctcgtaacttggaggtggcgtcgtctgacggttcaaggggacttcgctctcgatatctctatactcgtcatcactgaagaactgttggtatcttcgtatagactgagtaagcacttttttagttcctggagtgataggaaggtagggcatctgaataattgtgttactcactatacaacgcaatagtgcggtatgcatatgatgaacaccttcttggcttttctgcacgctatacacagaagcaagtaaaaagcctattacagagaggaggattcctgttcctcctgcagcacagcatcctatcattgctgcggtcattacagcaggagctccaggatctaaaaaaaatagagcaaaaacaaggcctacaattaaagctgctaaagatatcgtaataattaagccaagcacaaagaaaattaatgtggattgtctaaatactttacaagccttgattgtagattgtgaggcggcagcggcggctacagcccctgaacgatgtataaaaggatctgatttctgtacggaatttatgacctcagtgtgggttcttgataaagaggatattttcttggtaagttgataaattttatatgcagagtagcacaaaatgcctagtgtaggcccgaacacaatagctaagactgtaaagaggacagctgcgaaaataccggttatgagtgctccacagggatcagtgtgatgagaatctgtcactaacaacaggggacaacaccctattccaaatattttttcaaaaaatctctgataaatcattttcaagctgatattagaatacacttgaaagtgatgttcgccttctgtctctactacatctttcaaatcatctataatagcagttgacgaaagtgttcctcgggctaggaatactttaatcggaagaatctctgtgttatgttcaacaaattcgtccatagctaaagatactaggacgtcgcggacctgtgtattagaagcaatgcttgcctcatgtgaagaagaaagagaaatcatggcagacataaattttaccagaaaaatttatcacgcctctttgtttaaaaatagtcattttttatttaatgcaaggaagaagagtttccttggtctatttaaaaagacttctctttctaacgaagcgagctcatttccttaaggtttgattaatccagacattcctgccaattgaagaatcggggcttgcataaagactattgcggatgagagtctagcgtcctcactagtcctatgtgaaattataaatccgtgaattgcggttcctatgactgggacgattaacaagcacgcaagtagataaggaaggccaccaccatagaggcatttaaaatgtgatcccagacttactctttccccaggtaaagcactcgatgcactacataacttaaacggaaatgagagaagtagaaatagaacctttaaaatcaacaaaactacacttacaactgcacaaactacagcaattacaggatacaacatagtatctacaactaaacaagccgttttcttactcaagggttcatcatcataatctccttgagacattctaaaaaaaatagaacaagccataagaataaccgttggtttctgagaaaattgatataaagaacaatattttaaagatttttagttttaattggaataaaaattctaacccttccccctctaattacgatgtagttgtttaaaatatttttaattattagaaactacttgttattggtccatgaatataaaaatagaggtctttctagcttagaaaaacccctatctatagttattaccaatttataatagcagttgatcccacttgataagcaggagatataataaagtatcttaaacgattagtatccgattgtactgtaataatcgtgctataaattagggtccctatgatcggaataagtactaggcatcctaaccaatctgatggacctggtttatcctttggtccaaacaagcattgaaaattctctttacacgagggcagaggccttgatttacaagctgcaatacaggtattaacaaggaattttatagctaaaaacagtagttttactaccatcaagacggcaaaaacaactgcacaaatgaccgccataaaagggtagagaagaatatctgcaactagagctactttcgacgcaacgaatctgtcgggctcgtttgcattacacagatgataaccaatagaacaagccattattatcctccctttaacaaattttaataaaaaaactaaataattatagtttatttattaaaaaaaataaagttatattctttactatttccccgttcaagccaaagagacctcttttcttttaattttcttgtttttctatatttacagtattttgaaaagatatatagtagtcctagggaaaatcttgggactcataacgatccaattctatcagaatctaggtggaatgtcttcggagcgctatagtgctttgcattctaggaaaagtctctctgttttaccccatgtcgtacgaaaagtattgttaagtttccctgattttaggggtaatggtgacgtcaatttaaggagcattcgaagtgactaagggctctgtttttattattatggggcctccaggctcaggcaaaggaacccaatctcaatatcttgccaatagaataggcttaccccacatcagtactggggatttattaagagcgattattcgagaaggaactcctaatggattgaaggctaaagcctacctagataagggtgcttttgttcctagtgattttgtatgggaaatactgaaagaaaaactgcaaagccaagcctgctctaaaggatgcattatcgatgggttcccgagaaccttagatcaggcgcatcttctggatagttttcttatggacgtccattctaactacacggtgattttcctagagatttctgaagacgagatcttaaaaagagtgtgttcaagatttctttgcccctcctgttcgcgtatctacaacacaagtcagggacataccgaatgtccagactgtcatgtgcctttgatacggcgttctgacgataccccggaaatcattaaagaaagattaacaaaatatcaagaacgcacagctcctgttattgcctattatgacagcttagggaagctatgtagggtttcttctgaaaacaaagaggatcttgtttttgaagacattttgaaatgcatttataaatagtttttcttccttccaaagaaaagtaccgaattcacccgaaaaaaattcactcagaaccttgtcttaaacttgtcagaaggaaattatgaaacactacctatcattttctccttctgctgattttttctctaaacagggtgctattgaaactcaagtcctttttggagagcgcgtcttagtcaaagggagcacctgctatgcatattcccaattattccacaatgagctgttatggaagccctatccaggtcatagctttcgttctaccctagtcccctgcactcctgaatttcatatccatccaaatgtttctgtggtttctgtggatgcatttttagatccttgggggatccctcttccttttggaactttactccatgtgaattctcaaaataccgttattttccctaaggatattctcaatcatatgaacaccatctggggctccggcacacctcaatgcgatcctagacatctacgtcgtctaaattataacttctttgctgaacttttaattaaagacgcagaccttttactgaactttccctatgtatggggaggacggtctgtacacgaaagtctggaaaagccgggtgttgattgttcgggatttatcaatatcctttaccaggcacagggatacaacgtccctagaaacgctgcagatcaatatgcggattgtcattggatctctagctttgagaaccttccttctggtgggttaatatttctttaccctaaagaagaaaagcgtatttctcatgttatgttgaaacaggatagttccaccctcattcatgcttctggtggagggaaaaaagtggagtatttcattttagaacaagatgggaagtttttagattcgacttatctattttttagaaataatcagaggggacgggcattttttgggatccctagaaaaagaaaagcctttctgtaataagaaaggctttttccaaaaacgattcgaaaaacggtaaatatcttaacgcttagagaattggaagcttttacgagcttttttatgtccgtattttttacgttctttctttctaggatctctagtaagaaacccgcaactctttaggtcttgtctattctcttcattttcttttaagagagctcgtgcaaggcctaatcttgtagcaattacctgcccttgaatccctccaccgctcacacgaataattaaatcgtattgactttggtcttctgtaatttttttcaaaggagaaagaattgtagttctttgaatttccaaaggaaaataatcttcaaaagacttaccgtttacatcaattttaccacttccaggtcgtaaacggacgctagagacagcctgttttcttctacctgtagctacagattcttgtattgtactttttgccacaactcatcctaaattaaatatctaataaaattggcttttgagattcaaaagtttcgtatgaatccccttttacaatccttaaggacttcaattgtttctttcctaagcgagttctgggcatcattcccttgatcgcatgctcaataatgtaattaggttttctcgccatcatattttcaaaaggaatttctcgcattccagagatatatcctgtgtagtagcgatagattttttggcctttcttagctccagttaggcgaaccttctctgcattaataacaataacaccgtctcccatagccacatgaggagtataggtgactttatgcttgcctcttaaaatttttgccacttctgaagaaagccttcctaaggttttcccagcagcatcaacaacataccatgacttcgtagtttcactggactttactatagttgtttttgtgtcttttcttttttccataataatgtaactgtcttactagagagggcgattataagtctgttcaaatttttttccaaacaaaaacagccgaaaataacaagtctcttagtttaaaaatatttccataaatttcttttcgtacaattagcagttttttcttaacggctgctgatataaaagcattcagacaccgtctaaagctagatctcaaaaatatggatttatcttgaaatcagagggagtgttttcttaagagttatgaaaaaatagcttgccattggataagactccttccctagaacacctagaggcgaggtgcttattatgtgtcacaataagaattccacataatgcggatgcttgttctaacagaaggttatgaatctgttctgaagtctcttcatcgagattccccgaaggctcgtctgccaaaaggatggccggttcgttgattaacgctctagcaatagcgactcgctgtttttcccctcctgataatttagagcagcgagtccgtactttgtcttcaagattcactaaatccaagagctctagagccctggtatatacaggagatcctttagatatgttttttcgagcaattagagctggcattaagacattttttaatactgtgtcgtcttctagcaaataaaaattttggaagacaaagccgatatgctggtttctaaaattcgcaagatcctggttttttagatccttatcaaaaaagcgtaagcttccagaagaaggaacatccaaagttcctaagagatgcaatagcgtggttttaccattacctgaggctcctgtaatcgatatagtttctcctgcatgcagtgataacgatacatcggtcaaaatagaaatattttggttctgttgctggatagttttagaaaggtttttagcttctataagtaaggacatagctaatctgcttttaaaatttctgagacatgcatttttgcgacttttcttgcaggcagggctcctgaaactgcggctaaaagtagcgtacctaaccctagaaaataaatagcctgggggtgaacgctattgggaagattctggccaaagaaagcagtattaaatgtttctcttccctgtaaatagttcagtgcttttacaatgaattgtaaattttttaatgtaattatagcgaatatcgttcctataaccactccacaagctcctgaaaatgctccacaacaagcaaagatgatctttaaacttcgtgatgatgtccccatagctttaagaatgcctatttcctttttcttattatttacaaggagcatcgacatagtcacgatgttggagcaagcaacaataagaataagtatgcacacaaaaagaaagagaacttgatcactttgaagttgatctaggataggctggaaataatcgtaatcgtgtagggaagaaatctcccaatagtcatcgacacctaaggaagttagaatattttctatttgtttttttacaaagacaatgcgtttggtattggggaaaaatagatggaagccgttactcatccccaagccctcggattgagaacgaatggatctagcaagatctgggtctataaatacagttcttccccctaacggagagagcccgggattataaaatccgatgacatgaactgtatattgagtttctttttcattctctatggagtaggtactaaaaactcctgtatcccctactttataaccagagtctttataagtactagggagtatgatcgaagcccctcggtagagttcttctaaatgatggaaatcttgttgccatcccgaggggcttctattaaatggattcaattccgcagaggtatagtctgtttcatcgtagggtaaaaccttatcttcataggaaagcttagagggatacgttaaaaaatgcgtgagatttctaggctgaggtttttgtaattttagagaggttttgatatcgaggtaacccactccctgctcaaattcgatcactttcccgtgttgggattgaaggtagggtcctaaagattctagagtcatctttacaggatctttttgctgccctcctagatcacagtcttttaatggaaatgtttccggaagaaggtagtctgattcaggatcataagggtcgacttgtggagaagctattttttctcctaaagttttcgtagtgtagttagaaagactggagtgtttgtctatttgatagtagtacgaagaataatatgtgtcggagggaagaatagtaattggagaatggagttgggaaagatcctctatccatctttgttctaaaccgtgaatgactgaaataaaaactatagaaagccagacaacaagagaaatgatacccacagaaaatagggagactatagctgaatatagccttccccttcctggaatcaaatactttaaagctactgaaaattcgaacttcatgacttctaactaagaatacgattttagaagcgagtagttaagtacgatgaaatccttttacctagcttctttgaaaattacgtgcctacgcagttttctatcatattttttgagttctagtcgacctgttgtttttcttttgttttttacagtccagtacatatcagaactttccgagctttttaatttaataatctcccgattcttgcttgccatggatgagtccttttaagaaaatagtaaatcgcttactatgctatatttcttttcaaaaagaatcaagaactctcccaatcattattagagaacctaggatgacaacaaaaagtttaggatctttcaattcagttatttccaaaaataaaattcattttattagtttgggatgctctcggaaccttgtagatagcgaagtcatgctaggcattcttcttaaggcaggttacgagtctactaatgaaattgaagatgctgactatttaattttaaatacctgtgcgtttttaaaaagtgctagagatgaagctaaagattatctagaccatctaattgatgtaaaaaaagagaacgctaaaattattgtaactggatgcatgacttccaaccacaaagatgagcttaaaccctggatgtcacacatccattacctactaggttctggggatgttgagaatattctttctgctattgagtctcgtgaatctggagaaaaaatctctgcaaagagttacattgagatgggagaagttccaagacagctttccacaccaaaacactatgcctatttaaaagttgctgagggctgtagaaaacgttgtgctttttgtattattccttccattaaaggaaagctccgcagcaaacctctggatcaaattcttaaagaattccgcatccttgtaaacaagagtgtgaaagagattatattgatagctcaagacctaggagattatggaaaggatctctctacagaccgcagttcgcagctagaatcactattacatgagttactgaaagagcctggtgattattggctgcggatgttgtatttatatcctgatgaagtgagtgatggcattatagatcttatgcaatctaatcccaaacttcttccctatgtagatattcccttacagcacattaacgaccgtattttaaagcaaatgcgaagaacgacttctagggagcaaatcctaggattcctagaaaaattacgtgccaaggttcctcaggtctatatccgttcttctgttattgtgggtttccccggtgaaactcaggaagaattccaggagttagctgattttattggtgagggttggattgataatctcggaattttcttgtactctcaagaagcgaataccccggcagcagaactccctgaccagataccagaaaaagttaaagaatcgaggttgaaaattctatctcaaattcagaaacgcaatgtggataaacataatcagaagctcattggggaaaaaatagaagcagttattgataactatcatcctgaaacgaatcttttactcactgcaaggttctatggacaagctcctgaagtggacccttgtattattgtaaatgaggcgaagcttgtttctcattttggagaaagatgctttatagaaatcacagggactgctggttacgaccttgtagggcgtgttgtaaaaaaatctcagaaccaagctttgctaaaaactagcaaagcttagggtcctgtggttagttaacaaaaggcaaagtcgctatattccaagaaaaactttgcactctaaagctataacttcgattttccaaaacaaagtatccaggtctcacagcataatatgttgagcaaagccactgcattggtcgtgcacggtaataacttgttccagaacacgtcgacatagctaattcaattcttatgtcaggaaataacgggttttgatttgcttcatatgctaccaaaagaagctcccctcctgtaccattatcaatccaatctccatgcttggtcataaaaattgaaatacgaaagagcctaggaatagaagcacttgcttgaaatcgcatcatccaagtctgacttgagtcgatataaatagcggaattgatcactgtactttgtgttgacgtttgattgaacttattccaaggtacattgactccccccaaccaatatctcccgaacctacatgccctcctgaaagagcagctcgctgcatcatcatgactctggtaagtttgtagtatccataaggcacatactgttgaggttgctcagtattaatatttgcatagtcttgacgcttattccccaaggagtcttgataagaaaaaggagaattcgatagattcacccgaccgctgaaaaccatagtattgaaggtttgtggagtgatattgatatttcctccaacggaaagatcgttctggcatatcagtcctccatctgcatcaacaaaatttcctaaaacttgagtattctctgtagcaatattctgaccaatagtaagtgctgttttcttttgctcatcagtaaggttgattgattcgatgttaaatcgaacaaaagtaggaatcgatattgttattttttgtgttgtgggtatcgaactcgacattaatctacctccacaaaattagatggaaatggaaaccaaatgacacatgtggatagagacataaggttcatccatatcgtgctctctaagttaatccaaggatagtcataaggaggactagaaaccagctctgttacactgaagattgcagttacagcgacactcgtacggtcactcgaataacctcctctagtatctgaagtacaaagcaacgttttattatttccagagacaaaattaagaattagagtggcagaattatctccgtcatgttgtccgctccaccgtgtgagctgcatagtgacttgatagatcccgacttgtttgagtttaaccacaggctcaatatctgcatatctgctgaagtcaggggtcgcgttacgactcacacttttagaggtgatagctgcaacatgagtttcaattgtagtgttaggggcaacgtaataaccattcccaggataatacgtatagagattcgcagcctgacatccagtttttctataataactaaatgtaagcgcatctcgagcagactgaggatcactaatattattgcatactggagtttgcgatacgtctgtcttagaatagatattaaaaccgtcagagagtgtagtagcattaagttgagaaccttccgcagacacattacccttcacaataaattcacatggagaagtcgtggtatctaagactttgagatcccgagtctctaaattattttctattcttacattcctttcgacactgagagttgcttgatctataaataaattctgatctttgacccccagagttttcattgggatttataggtggagtcgtcgatccaaatatgtttccctgttgttttatttttttcataactaccctctatcgtccggataatagagaagagaaaaggagtaattccctatacctgcactagaaccaccgttactgagatagaaaatacccgctctatagcgatccgaagcattcggatcattaggattaggagctacatctacagaggctctatatattgaggtccccagtgtacctattgttgcataccctccaccactataaatcgtgctttcacattggacttgtcctaaaccattattgatataaatggctcctccccaaccattattccatccccaccgtttaccaacagtaaatgaaacgatataggttcctgctgcaagaaattgtatcgcagtatttccccctacagttaattctcgtgtactttgcttccatcctataaaacgaaatatactatttacattacgtgactgatatagagtatattccgaaccagtcagaggcaaataagattcccctgagttaaaatcaaaatctccgatcagaggcttggaacagaaaaaatattcgggagaacgaacataattcgctggcaccggatcgcagtcttcttttggcaatgcacaattactcagacgattatttttaaaatctatagagatttgggaggaagtaaagttttgtgcatttaaattataagtagttcctgaagttaatccagttgctgaaacttgatctttaaatgttgcattcccctgaacagaaaatgtttcagtcgatgagattccttgggcctgtgtatcaaaggtcttgagattggctgctaacaaatcaccatctacagttgagtctaatttaaaatagcactcattattattaatattgtttttcatgataacttttaataaagtttaatttatcaactcaaaatcaaattaataatattaagtcaaattattaaatttaaaatatagaaaagataagaatcagaaaatattcaaacttaagaaaagggattcaataaaaatgagtgtgaataaccgtaagaaatagaagccaagtgatataaggaaatcgaactccaagcatcgttagtttctaacaatacttggagttcgatgattattcaacgtaaggcaaggcaactatgttccaagaaaagaaagagactcttaaccctccaccagctctattctggaaagtaaagtaaccattattttgagcatagtatgtaacgcaaactacctgtaaaggacgtgtttcataataactggaccctctagaggtcgtcattgcaagatctgtgacatttatcctccctccgccttgctcatattcattcgccgctaagagaatatctgctcctgttccgttatccaaccaagaaccatgtttagccataataacactaatacgaaaaagttttggcaccttattatttacttcgaaaaccaatttagttgagtcatttgggtcaatataaatctctgttcctgatgttttttgagttgacgtttgatcgaacttattccaagggacataacttccagatggaacacttccaccacctacataccctgatgaatgagcagctcgctgtgccatcataatttgcgtacgtttataatacccgaaaggaacatattcttgaggtttccctgagctcattttttcatagtcggtaatgtcttgtccttgagaatttttataagacaaaggtgaattagataaatttaagcgaccatcaaaaaccatgctattggtgcttgtaggtctgatatttatatctttttgtattgtaagatccgattgacaagtcagtccgccgtctgtacaggtgagatctcctctaactacagtattttctgtagttacttttcccccaacagtaaatgtcgtttttttttgatcttcagtcaaattgatagattgaatattaaatctaacaaaagtcggaattgaaatttttgttttcggtgtaggatttgacattaatctacctccgcaaaattagcttgaaatggaaaccaaataacacatgttgacatggatttaatatctaaaccaatagtagtttctaagaataaccaagggtaatcatgagggggggtagcaacaatttctgttaaagtaaacgtgcctgttacagcaatactagtcctatgtcctcctgagtaacctctcgtatctgaagcacaaagcagcgtcttattattcccaatcattaagttcagatataaattaggattatcaagtccactatgttgcccgctctcgcgacgtatttgtattgtgacttgatagattccaggtgccttgaactgaatataggggaatctcgttacagcatcataaattttagctgaagcgctaatgcgatacgtctctggattcgggttttgacacaccgtttcgattggtttacctacagtagtaggctgagatgaactatagtaggtatacagattaagggcctggcatccagtgttcctataatagttatatgttaaagcatctcttggagattggggatcgctaacatttgtaaacttaggaactcggccatcctgatcttcagaagtgatctccaaacctttagaaagtgttgtcgctttaaattgagaactttctgctgataatccgcccccgacagtaaattcacatggagaagtgattgtatctgcaacttttaaatctcgagtctctaaaaagttttctatatcgacattgccatccacattaagagtcgcttgatcaagaaataagttctgatcttttattccagtattttcggctacatttgtagacggagtagaagcattaggtagaattttttgtaggtttcttcttttcataactacaccttatcccccgcaaaataaagaagtgtaaaggaatagttccctattaccgcgctgtgatctccattgcgaacaaacaaaaaattattcatatatttgtcacttggattgttcgggtcaggatctatatcactatgatctctatatactgcggtacttaaataccctatcgttgaataccctccgccactatacactgtgctcccgcacaacattgttccatcgccagtgtatttcccttcaaatagacgaatcgatcctccccaaccattgttccatccccagcgcttaccaatagtaaaagttaggatataggttcctgcagcaagaagttgtatggctgtgttccccccaagtgtaattttttcgaattttgatcccaatctacaaaacgaaaaacatcaccagccttgcttgactgatacaaagtatagtttgatccatctccagttataggtaagtatcgactacttccatcaaacataaaagtcccttctattggcttggcacagaaaaaatattggggagaacggacatagttcgcgggaacaggatcgcatgggtttttcggtaatgcgggattactaagacgattattcttcatatcgattgttattgaggaaggcgccgggcctgtagcatttaacttataggtagatgccgaagtcaaacctgttgctgaaactttctctttaaatgtcgcgttcccctgaacagaaaatgtttcagtcgatgagattcctttagcttgcttatcaaaagtctgaatattcgaagctaataagtctccatctactgttgaatcgagtttaaaataacactcattgttatcttgattatttgttgttgtcatttcaataaaatagttataagtttttcttttaaaaacaaaatagatctatttagtcaaataattaactaataataattctcttacgaaacaagataataaataaaattcacaaaaaataggaactgttcgcaatcaaaaacctttgattatcgattgagatttggaacttttaattcaaaagttctctccccgaatccaaataattttttacattttctgagcgaattgattagatagaaactatgagatgacaattcatgaaatgcattcccaatagttataagttttatataagatccttgagaattcaagatattgaagaaaaagaagtgggggtggctggatttgaaccaacgtatccgtaaggagccggatttacagtccgatgcaattgaccactatgcgacacccccaaaaatgctggagaaaggaattgaaccctcaaccgttcgattacaaatcgaatgctctgccaattgagctactccagcagaaatagaagtgcgattatctcaaaaagaaagttttattctcaatcagaaagtaacttatctgaaattaatcttcctcaactggaggtttttgagagttttcagatatgcgaaaatcttcttgtgtagggataaaatcctcacaaacaaaattagtgtcttgattcaaagtagctgtactctccataggtggagctagattctctccagtatttagaatctcaaaattatgctgctgaagtttctctgtaaccaatttctcttcttttgcctgagctttcttaagagcttttttactcattacttctttgttcttagtaatctgatgaaacttaccaacagccgctttctgttctgaagttaaagattgagataaacgctggaacaacttcgtacaattatctcctgcttctccctgctcggatgcagagagaacttcagcagaaaatttaaattttccttcagttgtataccgagctgtttgttcttctttttttaaacaacattgcttgtactttttattagaaccacaagggcataaatcatttctattaattttttttgacacgtgatcctcttccacacaagatcttttagaaaagtctaaataagctcaaaataaaatccaaagtcaaatgcaaaaacctattgcttttttctttaaccttggaacctagtactcgttaataaaaagaagaaaaacttaatgaataattaaaggtacaaactttatgccagcctattcacctgaactataagtttctggatttttaacagcgatttcttaagaataatattcctttaaccatccattcattgttttcatgtccactttacttttaaatcctccgtggatgaaagcgggaaaacgtatagaaagcttggtccgaaaagcactctatacccataccatgttagcaaatcatcgtaaaattgtagttgctctcagtggtgggaaagatagtcttacacttcttttaatgctcaaagcaatttctggaagaggattcccagatttagatctccacgcggtcaatatcggaggaaaatactcttgtggagcagaagttaataaaccttatttaacccgcatctgtgatcaactgtgcattccgtttagaacaattccctctccttatgcacccgaaaccccagaatgttatccatgctctcaagcaaggagacgtttacttttccaagccgctaaagaaataggagcttcggctatcgcttttggtcatcaccgagatgacctcgtccaaaccgccttattaaatcttctacataaagcagagtttgctggaatgcttcccgttttggatatggtccatttcggagttaccattttgcgccccttaattttcactcccgaattctggattcgcaagttcgctaaggaaaacggcttcgcaagagtcacttgccgttgtcccgtggtttcattaagaagcaaagcggaacaaagtttaaagttattagaagaggtattccctttagcacgtcataatatcgctttggcaattcaagaacatgggtcatccaaatcacaaaaaatttgagagacactttgttattaattaatttttaatataaataaggaagtaaaagtttacttggttctcatgaataaaagattaaagataattctaactaatgatgatggaatcacagctaaaggaatgagttgcctagtctctgctctattggaagcaaatattggtgatatttatattgcagctccccaagccgaacagtcggggaaaagcatggcaatctctctgaaccaagtagtctgcgcctctccgtatgcatacccgcaacccgttaaagaagcatgggcagtaggaggctctcctacagattgcgttagactcggccttagaacactttttgaatcggtttcccctgatttagtgatttcaggaattaactgtgggaacaacatatgcaagaatgcttggtattcaggaaccataggcgctgcaaaacaagccttggtcgatggcattccatcgatggcactttctcaggataaccatatttctttctttcaacaagacaaggctcctgaaattttaaaagcattagtgatttatctcttgtctcaaccctttccttgtttaactgggttaaatattaactttcctaccagtcctgggggttcctcttgggaaggtatgcgacttgtgcctccaggagatgaatttttttacgaggaacctcaatacctaggctctgtaaacaaaaatcaatattatgtagggaaaatttctggagtacggattggagagcatccatcagaagaactcgcttgcatgctagaaaaccatatcagcgtgtctcctatattttcacaaaactctcctatcggcttaatgactctagaggaatttcaaaagacacaagaaaatttcaatgcatcgcttttaagctctgagctgaccactaaaattttctaaaagccccctagtctttggtatcagaggtctttttttacaaaagatctcttgtttaatcgagatttaatcacttaaattgaaagaaaaataattgtgattaaactatttcttctggtaagtttatgctcctatcttattggatgcgtagctcagcggttagagcacctgtcttacacacagggggtcataggttcaaatcctgtcgtgtccatttgcgggagtagttcaattggttagagcaccgccctgtcaaggcggaagttgcgggttcgacccccgtctctcgcgaagtatgctttcagaggtttcaggatgtctcacggtccacgtccaacaaaattcagtttccctctgtatttctccaaaacattaagttggtttattttaggtggctttcttgctgcttgcggagttcagatggtattagtgcctaatgaacttatcgatggtggtattgttggcctctccattatagcctcgcattttttaggtcacaaagcccttcctttttgcttagttctcttcaatcttccttttgtattcctagcatttaagcaaattgggaaatactttgtgattcaaatgttgacagccgtgattattttttcgtgttctctctggcttattgatcaactcccctcttggctcggcatgagcccctttgtttttaaaggatcagaaatggaaaccgttgtgctaggcggtgctattattggcgtgggttgtggattgattatccgccacggagggtctacagatggcacagagattctaggaatcattatcaataaaaagaaaggctacactgttggccaaatcattttatttgtaaacttctttatctttgctttatctggtattgtctacaaaaattggcacactgctttcgtttcatttctaacctatggaattgcaacaaaagtcatggatatggtgattttaggcctcgaagatacgaagtctgtcactattattacctcttctccaagaaagctaggccatattctcatggaaaccttagggattggcttaacctatattcatgcagaaggaggatactccggagaacctagaaaccttctttatgttgttgtcgaacgtcttcaactttcacaactaaaagaaatcgttcatagagaagatccctcagcatttatcgccattgagaacctccatgaggtaatcaatggtagacgaacttaatccttgaaagaatcactctggattcgaccattgtttcgttaggtcgctagggatatttagataagcaaggatttttcctactaaagcattttcaagatcttcaaccgattgaggcttaaagtaccacataggcatcggcggaaaaatcgttgccccactcttgcttaattttaagagattttctaaatggatcgtatgcaaaggggtctctctagggacaagaatcaagggtcgcctttctttaagagccacatcagcaacacgtcgcagtaaattatctgctaaacctatggaaatagctgcaactgtagtcatactgcaaggaataatgatcgtagcttctacaggacaagatcctgacgctaaagagctctctatagcttgaatgctatgagtatgaatatactctaagttttcttctgaaaataatgcgtcaaaagactgacaccctagttcataatacaacgtctttcttcctgaaggagaaataattacttcaacttgatgttttgcatttacgagttccttaataagcttaacagctagtattaccccagaggcacctgaaatgcccacaacataacgcttcatctactcaaactccaaaacaaagtcatacttacaagaaacgatagagcaatcgcaatattcgctaaaaagaatttgctctctccttcttgatcttttttactgtagttagaatacattctaactaccttaagaatcacaactagaggaatgatagctgtgaaatagaactctttatctaaagaaccaacaaaacctgaaaaaatataagcaagataacttacccataagtttacttttgcaatttcaacggctttcttttcaccgtaatgtgcaggaacactacgcaatccttcttccctatcaaattcggtatcttcaattgcatatatgatatcatttgcagctattaccatacccacactccctccccataaaagagcaagaaagcataaacgcatggaaagccccgactcagcaaaagcacaaaaattcataagaatcgctacagtgtacaccaaccctaatccccaatggcagaaaaaagtcacccttttcatatagggatagacgatcataagagtcagtgaagcgatgcccaaactaaaaatacggagaatcttgcagagaaaaagaaaaagaaaactacaaaatagagagagtacccaagcaaaatttaaagaaacaagattcgcaggaaggactcttttcgatgttcttgtattttttttatcaatgaaccggtcgatacactgattcactacaattcccgtagtccttgcaaaaacaaaggctatggctccaaaaactgaaatcttgaacccttctttaaatgataaattttgggaaatctcatttatagaaagagcaaagactgtggatgctgataaaaaaagtattgaaaatattgaatacttaaaattaactaaatttaaaaaataatttaatctcacaattattatcttctatataattatttttttatttataaaaaaaatatactcctctctattcatcgggggtgatccccccaatctttttagaaccccctatgttagggggttcgtctttttatgcctctactgtgtacatttcaggcattagtgcgatacatttttcttaaatccaaaaagttccatgttctttcgtatagagggtagttcttgtgcatcagaaatggtccttaaacaaaactcctaacgccaagacaacaagctgattatgaagtgcttgtcaaaacaaaaatccttttaaatatattgctctttaaagaaaaataatgacaagaaattcgtaaaaaagcgctgttttattaacaaaaaggaagagactttatacttatgattctagtacaaaattgcagaatcagatgaaaagaactgtactagggtttttaaaatttagttattatatcaagaaataaaattaaaaatacctttaacctaaaaagattaatcttgatttaattgatttttctaataaaattattcgatctcaaaaataaaacgagtagataatggcgttagatgaaattaataatcagaacaacccatcgcaacagatagcctcctcgacttctcaaacttctaaaatcaaccaagatcgaaaaactttcgcatgcactgttaccctacttgttgtagcaactttgatgatcctatccgggattgttttgctatttactataggttccctaggactcagcgttcctttatctggaattctagggacttttgcagtgacagtaggagctgttctctttatcacaggtctaactattctagttagaaaatccctaggaatcgaacagaaaaacgaagacttgaattttttaaagattaagaccccaactcccccagcacgccccctaatgtcaaagtttagtgttacctgctccactacaagtattgttttaggaatggctcttcttatcggtgctgtcgtctccgtattttttctcacaggatatctacaactaggcttgtgtgcaggacttgtaggtcttggaaccgccctatttgttgcaggattagcaaggatgtcccctcgtagcctagcagaccaagaaggctccggctccgccgattctcaatcaaatattgttggaataggtgagccaaaagcagctcaggaacaaaaatggtataaaatggcagtggtaaggggagaagatggtataccaacagcaattcgcctaacaccagagaaataaactattattttaagaacaaaaaagggttttaaagtaggtaaatgagaaaacttactcactataaaactcttaaaactataaaaattccgaacttttatactatatcgaaagcaattcatccaggaattacagaaaattgaaaaactatttaataatctacctaaattttctgatttaaagaactataagatgtaactttaacgatttttttagtaaactaattcggattaaaaatgaaatgagtgtcaataatgtcattgaataaaaccaatgcccttctcaatcaaccagagcctgctgtttgccttaatgcttgggaccctaaatatatcaaccaagatcgaaaaactttcgcatgcactgttaccctacttgttatagcaactctgatgatcctaacaacaggagttatcgtattacttgctatgggctctcctggattaagcgttcttgtatcaacaattataggaacctctgtaacaactttagggactgctctcttcataattggtttagttaaactaattaaaaaatcattagcatggatacagtatcagaaatactttcaagaagtcgtaaaacagaaatatgaaccctttagcattcctaaaaatgataacgtacacaaactcacttcgtgcttaccatcacctttagatattgagagtccgtctccagaagcaagtaccccagtctctaagttacgcattgcatgttcaggagtcgctattgttttaggagtgactcttcttattggtgctgtcgtctccgtatttttctgcactggatacctacaactagctctatgtgtaggattcgcttgtcttggaactgccctctttgttgggggattggcagggttgcggacccacagcttaatcgctcagggcatcatgtatctttacctgacttactatctatcatcggctctggaagaaagaaacgaaacagtcaaggatcagcgtaacgaaatcaatacatatttaaccgaggaatgcaggcagcaaaaaagggaaaaggcgctgttggaatagaaacaatgggcactatctctcatgtctcaatgtcagagtagcagtacatctacctgggaatggatgaaatcttttgtgccaaactggaagaatccaactccccccttatctcctataccttctgaggacgaatttatattagcatacgagccatttgttctaccgaaaacagatccagaaaacgcacaagctaatcctccaggcacatctacaccgaatgtagaaaacgggatcgatgatctcaaccctcttctggggcaacccaacgaacaaaacaatgccaacaatccaggaacttctggatctaatcctacatctctacccgcccccgaacgactccctgaaactgaagagaacagccaagaagaagaacaaggatctcaaaataatgaggatcttataggataaaaacagtgcgaatgagttccgccctgtttaatactgtgttaagaaagagcagccattcagataaatgtccagctaaagcaagaaggacaaagactcttgcttctcctttgatacaagaaatgactcctatctttcatagtttatagcaatactataatttcacgtctgttatctttggattcacttgttctacaatgacttgctttaaaaatttctcagcccgagaagaaagtatggactctgctttccctttagaaaaaatacgatgaatcaactgatttagaacgggatgggcttccgcagaactacactcattaaaaaagaaattttcgtcttcatttgcataaaagaaatccgacccaagaacaatacttgataaaattccgagattctccgcatggaggacatgcttctccaaatcacccaaggaatctcctacataagacctcactagattcaaaccaataacaccttttcttctcacaatctccttggcatgggcatctacaaggttccttcgatgatcaagaacagatcgaaaattagaatgactggcaatcactgcgagattgggcaatttatcggcagtataatctaaaatatcttcagctaacttatcactacaatggctaagatctattggaactccaagttcgtacatgatatctaaaagaaccttaccatcattagaaagtctcttaggagcttctgtgccgcctccaaaacggttatcccctttccatacgattcctagataggcaagaggcccctgtttagttaaatgtataagctttgctaatagagtcccaaggggggcggtatcatctcccaaagctgaggcattttctatactacgaataagacttagtgattttttttgagaagaggatccgttctcttcttcttcataagataataacccaatatccggatattggttaggaagagaaaaaaacagagagttttgtttatcacaattaggttccccccgactgtgggggacaaaaatagcacacacctgctgacgtacgcctccagataggagttgttctggagaacacctcaccgcaggatctttccgacaaaaatgcggatgcgaaagtaagtcacaatgcatatcgatagtcataacacacctaaatgctactcaatataataaggggaaagaaaggggaaaagttcgggataatccgatgtatttatatcataaataaagactatagaaggagttttcttttttaaagcttcccgtaatctggtataaaaattcttaggtttaggatgttcacaaaccacacctttaaaatctaaagatccgctcaaaaaagatactaattgctcttgatttttcactgtatagatcttgatatgcttcgaaaaggcatgtgacgttctatgaaaaatcttagcttcagtccctgcaatgttttctataacactgcgagaaatcagcccctcacgataaatataaagaggatctgaggcaactactgtggactctaaaccatgggaacaagggccatcaaaaatacagagatcatgatcagcaaagtctgcgaatatctcttgagctgtaagagctgaaggaaactctgaaagattcgcagatgttccgattaaggttccacagtgatccacaatttcccgaactacagagtgatctacaatgcgaaacgctagtgtttctttagggaatctaggattgcggtgcttaactactaaagtaattgctcctgggaaaagttgagctaatttcttagctgtaggagataagggataaccagaaatgttttcaatatcttcaatagaatttacataaagggcaaaagctttactaggttctctatcttttaaagcatagagtctttcttcagcttcagaggcatacaagctaagaacaaacccatagacagtgtcagtaggaagagcgacaattttcccttgatgtatagctgacataacctctggaagcgaaaaagtaatctgtgcttttttatcaggcacaataactccaaaaatagattaaagaaggtctatgttttttagaatccgcacaaaaccgcttatacatataatttgtacgctctttatcaaaaagagaattccttagattaacgcaaaaagttaatctaaatccataatttttattcagaaaatagattttttattaacttatacaaactaaacattcaaaaatccaaaactacatcttaaaatattgactacgccacttgaagacaaaaaagaaattattgatccctaattcccttcgatataacgtggtaacttcttattattaaaaataaaaacttatgacagactactctttctttcgtcgcaaaattggcaatattgaagccatagagtgccctggaaatcctcaagatcctatcattattctgtgtcatggttacggatcacttgctgataatctcaccttctttccttcgatatgttccttttcaaaattacgccccacatggatttttccaaatggaatccttcccttggagaatgacttccgaggctctcgtgcatgctttcctcttaatgttcttttattacaagaactctctaggctctatgccaatggagtagggaaccttcaagaaaaatatgatgaactatttgatgtagatctagagacaccgaaagaagctttggaagaacttatcctcaatctcaatcgaccctataatgaaattatcattggtggatttagtcaaggagccatcctggctacccaccttgtcttaacttctcagaatccttatgctggagccttaatctttgctggcgcaagactgttcaatcaaggctgggaagaaggacttaaacaatgtgctcaagtgccatttttacaaagccacggttatgaagacgaaattcttccttatcacttaggagcacaccttaatgatcttctattaacaaagttgaacgggcaatttgtttctttccatggaggacatgaaattccctctgtagtattccaaaaaatgcaagttacagttcctaattggatagatcctgcccggggctgacagaaacgagttccttttctttatactggagagataccaactgaatagctacccattctaaaacagatgctgccgatgaggagttattcaatgaccgacaggcagattccacaattaaaagcaccttatctaaaggcagtaatggcaattgtaggatctccttaacatgctcaggatagtttaaagctgaagcctttaatcctaaattcagagtataacgatctcgatatagctctaggagcacttccatgaatcgttgcaccttgtctcttaacacctgtttatctgtctctgaagattcttttataatttgagacacttcagtaacgggaatttcacattgggcatagcgaaataaataagaaaacgtctctttggaacataagattttttctcccctctcaataaaaatagagagactccgagaaatgatagtctttggcaatctctgaacttttgctgttgtcaatatgataacagcatgtttcggaggttcttcgaagacttttaaaaatgcggaaatcgcagctaaagtcattcgatctgcttcgtgaataatgtagatcttatagtttgcttcaaaaggagatatataaatctgcttcttaattcccctaggaagatctatagagtgcagtcttccctttccttctggaaagaattgataaatatcgggatgaatcttttgagaaactttatgttcggaacctggagatgacgatagcaaaatctccgatgctaactgttctgctttatcctgtaaaacaggaagggtaaatccatgcagcagtatagctggaggcacttcctgatgataaactttcctaagtaaagcttcccagccttgattctcttcttctaggtgcataacccaagttgcgtatgtagcatcactttgtctattaaactagctagtgattcacgagcatcaagaaccaagtaacgactaggatcggcactagcaagagataaaaatccttctcggatcctgttatgatagctcaaaggctttttttcaaacttgtcaaaaaccttttgtcggtgcttcctttgtaagccaatgtctgcaggaatatccaagagtaaaacaaaattaggaaggaaaggtgtaggtcctacaaccttagaacaaaggtcggcaacaaaatcagcacccaaaccttcggctattccctgatacacaatcgtggaatcgtggaatctctcacaaatgacaatatagccatcacgcaatgcgggaatgatcacttcctgaatatgttgagcacgtgatccaagaaacaaaaagagttcacaacagcgagagagttctaagtgaggaggttccaaaattaaatctcggagtctttcgcctataaggcaccctccaggttcccttgttaacaaaaccttccgatcttgagctactagctgatctcctaaagcctttgctaaagaacttttgccagacccttcgcccccctcaatcacgataaacacaatactaccttaggcttactgtatcagaacattcttcttcggaccctgatagtacttcatcatcattttcattagaagagagtttttccatagaaacaagagcatccccttctttcaagtgaactaaacgcaccccttgagtcgatcttcccatcactctaacatcttgcatgttaatgcgaattgcctgtccctgactcgacattaataaaatactgtcgtgatccgtaacaggaatagctcctaggacattgccgtttctttcattgataaggatagaacgtacgcccacgcctccacgattggtttcgcggaaatcttcaactaaagatctcttaccaaaaccttgatcacatacaattaaaaccgactggttctcagtcacaatttgacaactgacaactttatcttcttcatttttcaaagagacaccgcgaaccccacgtgcagttctacccataggacgaactttttcatgggggaagcgaactgccataccaagatgagtaaataacattaccttctcttcatcactaacaatgtgacaagctgctatgagttcgtctccctcatctatctctaaagcacgtattccctttttcctagggttgctaaaggcgtctaaggaaacttttttcacaacaccacgtttggtggctaaaaataagaagccggcattatcaaaattcttaatattcaatatagctgcgagctcctcaccaggacgaattccctctaggaagttgatgatgggcttacctttcgccctccgctccccttctgggagctgccataccttcaaccaataacattggccaaaattggtgaagattaagagatagtctttagtaaaggcagagtatacagctttaaggaaccctgctcccttcttcatatcaaatcccgtaactccatgcccgccacgacgttgttctttgaacacttttacaggcattctctttacgtaatcatctccggatatcgtgataataacagactcattggtaatgatgtcttcaatatcacgaatatcatcagcatcgaattctatagtagtgcgtcgagctaccttatgatgcttcaaaagatcttgtaactcatttctgatgatatcttttactaaaccttcatccgataaaacttgtttataataagctatcttatttaataactcttcgtactctttttgaatcttttcagcttctaaaccagtaagttgatataaacgcagttctaaaatcgcaagagcttgaggttcggtaaaaccaaaagattcaataatccgttctttagcatgctctttattcccactctcgcggatcgtttttactaatgcatctaagcaagataaagccttaaggtatccttctaaaacatgagctcgtgtttctgctttatttaattcataacgagtcctacgacggatgacttctttacgatggcgtatccaagcggaaatcatcctatgaatactcatcgttctaggtaagttcttatccagggcaagcatatttgccccaaaagttacctgaacatcggtgaacttgtagagcctattgataatgatttccgaagattctccttttttgatttcaaggacaacacggattccatctttatcagactcatcgcgaacatctgaaatgcctgcgagagtcttttcattcacaagatttgcaatttgctcaatcaaacgtgatttattcacattataaggcatctctgtgatgatgatgctctcacgatgtttatcttcattctcttctacatgcagacgagctcgaactttaatctttcctcgtcctgtagtatacgcggagcgaattccttcagaaccgcagataattcctcctgtagggaaatcagggcctggcatgacttgtaaaatctcatccacagaagcctgtggatttgcaagcagaagaagtgtagcttctataagttcccctaaattgtgtggggggatattcgttgccatcccaacagcaattcctgaagaaccattgcaaagaagattcggaaatttagaaggaaaaactacaggctcgtgttttgtttcatcatagtttggaacaatatccacagtatctttgtccaagtcttccataagatacatagcactatgggtaagacgagcttctgtgtatcgcatagcagcaggtggatctccgtctatggagccgaagtttccttgtccgtccaccaaaggataacgcatcgcccagttctgagccatacggacaagcgtaggataaatgacgctctcaccatgtggatggtagtctccagaggtatccccacaaatttttgcacatttacgatgcttagctcctggagaaagacttagctgcttcatggcataaagaactcttctttgtgaaggcttgagtccatcccggatatctggaagagcccgagatataatcacagacatcgaataacgaaggtaactttccttcatctcttcttcaagatttttagggactataatttcatctttattgaacatagggattgtggactcctaaatatctaaattatttatcctaatggacaaagcatgactttctatgaattctcttcttggagggacttcttcccccatcaacatagtgaaaatatggtctgcttctacggcatccttcaatgacacatgaatgagtgttctctgctcaggattcatagtagtatcccaaagctggtcggcattcatctctccaagacctttatacctctgaatttctatgccttttcttccaagatttttaagatagttaatgacttcttccaaggtatagcagctatagttacagcttggggaatcttcatttccaatcacaatctcgtttttctgagggataagatagctagaaatatctaaaccatattctttgagttgattttgaatatctacgaacacagcaactttataaagctctatgattttaaacttatgagtttcttcttgagctaaagcttcttctttttcctcatcagaataaagatagcgccctccctgcattccagttgccggagcaagatagtacaaaggatagcctatcccctctttatacatctctaaaaattcagagaagggaatcgcttttttctcaagagtgtttataaagctctctacatctaaaatgacgttgataaaactctctaaagcctctccacgtaattctctttccgtagatttaaagagaatggagctctcattcgtgcctaacatgagcaaatagctgtccatttctttctctgaaagaatataacggaagtcttttttcttactcaccttgtataaaggaggttgagcaatataaacacattcattttcaataagcgctgtcatatgacgatagaagaatgtgagaagtagggtacgaatatgagaaccgtccacgtcagcatctgtcatgataatgatacgtctatagcgtaatttactgagattaaaattatcagcacctatgccacagcctaaagctgctatgatggttcctatctcttggttttggaaaattttctgtagacgagctttttctacgttcagaattttacctcgaataggcagaattgcttgaaatcttcgatctctaccttgtttcgcagatcctccagcagaatccccctccacaatgtacatctcacacttttcgggatctttttctaaacaatcaattagttttccaggtaagcgtgcgctatctaaagcacttttccttaaagtcaattctcgagctttttttgcagcttctctagcttgcgctgcaacaaaaaccttatcaacaatcatcctagcaatttgaggattctcttcaaaaaagattgtcagagcttcccctacaacctgttgagccactgagctaacatcactgtttcctaatttctgttttgtttgcccttcaaattgtggatttgggacctttacagaaatcacagctgtcagaccttctcgaatatcttctccggttaatgcaagcttattattcttcgcaaggttatgagctttaatatacgtattgattaccctagtaagcgcggtagaaaaccctgtaagatgcgttcctccttggcgtgtaggaatattattggcataggaataaacaagttcagaataccctgaattccattgtaaggctgcttcaaactcgatttctccatcatctcctactcgagttccacaaatataaatcggttcagagaaaaggctttctttattttgattcaggtaacttacaaaagattgaatccctccctcataaaagaaggtaaccttgtcaaagctaacatctcgatcatcttcaaagactattgtgatcccacgatttaagaaagcaagctctcgcaagcgtttcattaaaatagagcgatcaaaagtacaagtcgaaaatattttaggatcagggtagaaaacgatttctgttccctgccgatcactaacacttacatactgcaatggagttacaggaattcccctagagaactccatttgataacacttcttatctttaaagaccgtggcaactaatttctccgaaagagcattaacgcaagaaaccccaactccgtgcaagcctccggatactttatagctatccttatcgaattttcctccagcatgaaggactgttaaaaccacttctaaagcagagacctctctaccttgttttgcagactctctttcgtgaacttctatagggattcctcggccattatctacgatgacaatacccccgtcctctaaaatgcgaacatcaatcctagagcaataacctgccatggcttcgtcaatgctgttgtctacaacctcatagactagatgatgaagacccgtgattcccgtatctccaatgtacatcccggggcgctcacgaacagcttgtagcccttctaaaacagtaatagcggatgcatcgtaatttttttcttttgggtccataaactatcctaacaaaaactgtatttccctaatctgcacgtgagaagccacctgatacaaactcataattaaatcattttgaggcgtctgttttaacaaagcatataacgaggaattgtaaacttttactaacaaaatatgatctctgaaccctatagcttgagacatccctttatatttgtctctaaaaacctgattccaagcgtcaatagcgtcatgaggcctagctgccataattttttgaagttcctgcaaataattatggagatagtgtttagcgtgttttataggggaagctgttcttttattttgaacttgagatcctccccttttttttcgctttaagaacatatcctacctgaagaataacacagcgcatatcacaaaaacacagatttatcaaattgagagacctttatgtctcgtcttttctctgtttttctttatgatcagtttttaaataaagttttaataacatgctgcatcaaaagaaacttcttatatccacagaaacgaaaaaagtcaataagacgaagaggaattcttatgataaaaatcccttttaggggctgtaaagatgttaagagagcagtaaacacacatgtcgttacatgctaaacatatacaacggtaggataaggcttatctggagaaataagagtcttcacctctataggctctagctcttcaccttgagagcaaaaacctaggtactttacaaccaccaccacgcagaatgcaatcgctcctataatagcgactacacaaactccaaggccaaacaagcaaacgcatagaacatctatgaggcattttattaatttaatgattacttggagcactaaggctgtgatttctaacgctagtataacgatccctccgccgagaatctctacaactccacgaacccgatgtgcccaaagatttacagaagttgaggatttactatgtgttgatttctctaatttttcctgcgcaacttcctctatatcctcagcataagtgctactaattctagaacaacctataactatattcaaaataggaatagcagcttggaaattagttgaaaactgctgaacagaagtaataccaaaagctggggctctaacattaattatcattagaattacaccgtagaaaattagggggggtagattctttatgagaacttcttttccttcaataaaatatttcgggtaaaagatcgaaatattttattgaaggaaataagatcaaaaagagcgcacaagtacaacgacttattgctctaaccattgtcttgagtcattgtcaaaatattcccatgatattttgtatcaaaaaaatgttgtacagaaggagattgaaacagcttctgtaattttatcattttaggagaacctacgtcttcagaacgaatgacaacaaggtttgtatacttagataccgaaagatcctctaaacaaagactatctttctttggagaaaggtttgctgctatagcaaaatttccaggaatgacagcagcatcaacgtcaggaagagatccgacaagaagaggagctgacacctctaatatgttgatacttctattttctttcccacagacatctttagctgtcatatttaaattagcaggccctttgcaaacaatgagtccgcactcttctaacaagtgtagagcacgctgagcattcgtacgatccacaggaatcgctatagtcagtttcttctggctttttaagcgctctaaagaagaatgtttcttagaataaattgcttgaggttccaaatgaactttagcgataacaactaattcacccttacaatcataacgctcgcattcgtcatcaagaaaagcttgatgttgaaagtaatttgcatctacttgtttatccaaaagcaaacgattaggaatacgataatcatctactggaagtattttcagcttgattccaagatctttagcctcttcctgtaaactctccaataattccgcatgaggtgtcggactggctacaatacgtattttattctgagcatcttccttatggcaagaactcaaaacaaaaattaaacctacaagtaatgataatttttttttcatagaatccctctatactttaatacacgacgcccccagaaatctcctagaatacgcactgactcgataagaactaaagtgatgacaagtactgatgttgtgacagaccattcaaaacggtagtaaccatactgcaataataactgtcctagccctccgcctccaacaaatcctgcaagagtcgaacatgaaatgagatgaacaacaagagacttaagagaaaatatgagctgtggatagctttcaggtagaagtataccaaaaagaatattccttttaggaattcccaaagcaacggcagattcaagatagttaagggctgaattacgaaaagcatcaaccactatagtaacaacaaaaggaatggctccgatagtgagaggaacaatagaagccgtagggcctaaagaagtccctacaatccatcgcgtgatcggaaaaagaataacaataagaatcgcaaatggaatcgcggtaagaaaacttagaatcattgagattgttgcgtaaaggcttttcttaggattaagactcttaggcgacgtgcagaaaagccccaaacctagcatccctccaatagcacaagagaagaaaaaagcagtcgacaccatataaagtgtattgactgtttcttttaataaaatctgaataagatcggattgcataatctttttctaataaaattctttaataacgacgcctagctcaattaaaagctcttttgcttttttacgttgctcaacttccccttccaaaacaataattagaaatcccattggggattttctaaataaattaatgttgccggaaagaatattgatagagaccagtccagtctgaatcaccttactaatgatcccttgtatagcgagttctttggaaaaatttaatctaagaacttcttccctgtcttctgcaaaataacacgaactcaaagcagcaatatttatatcttcatggaacaattcatttgtaattgagttctcagaatttaaaaaaagttcttctgtagttcctagttcttcgacagcaccttgatgcattaccaaaacatgagagcatattttttttactacatcgatctcatgcgacactaaaactaaagtaattcccctttcctgattcaattgaagcagcctttcaataatattttcagtagatttaggatccaaagcagaggtaatctcatcacaaagcacaacttcaggttgacacacaattgccctggcaatggcaactttttgtttctgaccaccacttaaatttcctggataggcgtcatgtctatgatagaggtttaaaaaattaagagtatcgtatacctgttcctcaacttcactcttagacatttctgaatgatgaatacgcaaaggataggctatgttttcaaatacggttttcgaagaaaacaacccataattttgagaaatataggcaacttttttagaaaaattacgacgtgaaaacttctgtgttggcaaagagttatcaaacccagctacacttatagagccagatgtcggcatgtcaagaaagtctaaacaacgcaaaagcgttgttttcccagaaccgctatgaccaactataccaaaaacctctccaggatagacagaaaaggagactttggagagaagaatatggtcgcctaacttcttactaacatcttgaacggaaatgataggagaatgttgttctgacacaagccacgcctctccttttatttatgaatataaaatagaatacaaagaatcttgaagattcgttaaccattaaactataatactatatatttctgcaagcaagtttactgctcttaaaattttgttatcaaactatctaatataaacaaaaagagggttgaatagatgtaagttctatttcaaacgacacaacatttgatctactatacaacaagatttcatcgaaagcattttcaagacgaacttcttggtgacgatacatcacaaaaaataaatagctgcgattttaaacagacgcatcaaaaatatatagaactaagaacaacttgaaattttaacataataaaaaaaatactccttaagtcttttataatacattaaaaaactaatacttaacttaataaactcgttgataaagttccttgacaaatccctgggttaaccccaaactgagctctgaataagcttaaggagacacaccctcatgttgaatattcatgatattctaggaaatgatgacgaaaacctattgtcatatcaatgcaaacacattacaaaagacaaactaactcttccctctcatgattttgtagacaaggtatttggactctctgataggaataatcgtgttctcagatccctacaaactatgttttctcatggaaggttagcaaattcaggttatctatctatacttcctgtagaccaaggcatagagcactcggcaggagcctcttttgctattaatcctatatattttgatccagaaaacattgtgaagcttgccatagaatctggatgtagtgctgtggcctctacctatggaacactgagcttactttctaggaaatatgctcataagattccctttatgctaaagctaaaccacaacgaactcctctcctatccaacaaaatatcatcaaattttctttactcaagtagaagcagcttattcaatgggcgccgttgccgtaggagctactgtttatttcggttctgagacttctaatgaagaaattgtagcagtttctaatgcatttgctaaagctcgttccctaggtcttgcaacagtactttggtgctatctacgcaatccagcttttgttgctaatggagtagattatcatacggcagcagatctaacaggacaggctgatcatttaggcgctaccctaggagccgatattgtgaaacaaaagctccccacatgccagggaggatttaaggccatcaattttgggaaaacagacgaaagagtgtattctgaactctcttcaaatcatcccattgatctttgccgttatcaagtcttaaatagctactgtggcaaggtaggcctaattaactcgggaggaccttcagggaaaaatgattttacagaagcggctagaacagcagtgatcaacaaaagagcagggggaatgggtctcattcttggaagaaaagctttccaacgtcccctatccgaaggcatccaattattaaacctggttcaagatatctatttagatcctaatattacaatcgcttaacttttcaaagaaggtctttatgcactcccactcaaaaccaacgaaaccgttgggaacattcacggtcggcatgttatcacttgctgtagtgattagtttgcgtaatctcccgttaacagcaaaacatggtctttccactctgtttttttatggactagcagtcatatgttttatgattccgtatgctctgatttctgctgagcttgcttctttcaagcctcagggaatttatatttgggcacgtgacgctctaggcaaatggtggggattctttgctatatggatgcaatggtttcacaacatgacgtggtatcctgccgtgttagcttttatagcgagtaccattgtttataaaatcaatccagaactcgctcacaacaaagtgtacattgcaaccgtgatccttgctggtttttggatacttacattttttaattttttaggaattacttcttccgcattattcagctctatttgtgtaatcataggaacattaattccaggagtcatcttagttagtttggctctcttttggattttttctggcaatcccattgctatttctctttcttggggaaatcttcttcctaatttcagtaacgtatcttcacttgtactactagctggaatgttacttgcgttatgtggtctagaggctaatgcgaaccttgcttctgatatggtaaatcctagaaaaaattatccaaaggcagtcttcattggtgcaatagcaacactcactattttagttctgggttctttatccatagcaatagtgattccgaaagaagaaattagtttagtctctggactagtaaaaacgtttaccttgttctttgataaatataacctctcctggatgactggaatcgttgtagtcatgaccattgcaggatcgctaggcgaacttaatgcttggatgtttgcaggaacaaaggggctttttatttccactcagaatgactgtcttccccgactctttaagaaagtaaatagcaaaaatgttccaacgaacttaatgttattccaaggtattgttgtgacaatattcacacttttatttctatgccttgattcagcagacctggtgtattggattttaactgcactgagcgtgcagatgtatcttgcgatgtacatctgtctgtttcttgcaggaccgatcttacgtatcaaagaaccaagggctcaacgcctctattctgtaccaggaaagtttttgggaatctgtacgatgtctatcttaggaattctctcctgtgcgtttgctctttgggtgagcttcctgcctcctagagaacttgctcagatatctgaaggcagcaaaataggatatactacattcctgcttttagcatttagcttgaattgcttaattcctttcggaatctatttcacgcataaacgcttatctaaaaagagctaatctaaaagcatttttgggaaaagaaaagaaagaagccttccttgttgtatggcagcctggaaagcttctggattcaaatttgctctcctgcaaaaagtttcaatctctccttgacaaataagtcctgtttgaaaatatcctaaatatatcgcgtgtaaaagcttatcccataaatgtataggcattaataactttaggtatttacctacagatatgctgaattcctctgattccagtagagcctctaagaaaatgaatgggttttgtttcatcttctttctatcgatagccattagaatctctgccccctgtttgaaccgtcgagctcgcaaaagctgtggtatcgatgtaatagacaacgcaggaagaacaagttttttcaatccttccttacaagcttccttggtcttattgaagtcttcttgctgatcctcggcatctttggcacaatcctcactattaatactttgccaacagctgggatctggctcagggtatagagcattcggtactattaaatccaaccttaatgacagttggtttagcaaggcgacttcgtccccttcaaacagatgatgtaaaaatggagttaatatatttctttgttctacaaaattttgcacctcttcagaagaaaattggggacaaaattgctgaataatcttaactgcctgagacctatcatgactagatcgtaaacacaaccctgaaagtaggagattaatgcttatcaggcccaaagaacaagattctatggtttcagctgtttcactggaaatttcgatcccaagggtcgagtgtttcttcggatctagcatacttttcaaccacataggatctaaagaaaataatacttctaatatctcttctcctggagcttctaaaatttctagtaaaacttcataaagaggagcaattgaggaattctttaaatctttcttcgcaaattttataagaagcttcactgggttagggggtgattttcgaaagctaataatcttagcaacagcattttttataagatcttggaagtatgagagtcttcttccctactctcattaggccttccctgctcatctagaaaatttgaataaggaagcatcttcggcctacggaaatcatcagctggaaagttcttaagaagttcatcaattgcagacactgaatcttcttctcgacctaagagtaaattaagatcctcatcagagaaaaatactgaaggactggttatagaaaagaccttagtcttttctatagaagattgctgatagaataaataggcaacgcaaagaacagagcagaccgatagagggatcagcatgcccaaaacaaacgtcccaacactaatgatgccacaaaagtagagaacagacatcagtgtggctatagctaagatagctaaaatcaaataagtaatcggtcttaaactacttttcaatgaaagaccatagctacttgtgttgttcactacaggctcatctatgactggtacttggggagcgggtatgttcatatctaaaaatcaaataagtgttgtaataaaagatccagaatttttccagacgctatcgcttgcgttatctctttgaaaggaactcctaaatgttctgctataatcttaagttccttttttctagctatgccagaacaaagcattcccattagcataggacgaaaaagcgcagcccaattactcatcggcattgctttctctaataaaccttttaagaaagtctgacacttgggattctcgtgtagcaattctattaataaaaatgggttttgtaaaataacagattgttgatttgagaagaatgtaaataaaagggagaagtccttgtagtggctagctacagaactagtaaaattccaactggagggtgacggtatcttctcacaaaatgctaggcgctcactcaaagactttttaagaacgcttagatctttaaagtcatacatatactcagaagagttgattgccggaacgtagttgctcccatctttagctgaaggaagttcctgagcatcgcttgggaaaagagctcgaaactccctttgcatctcagaagactggaaagataaaagaaactgcactatatttcctgcttctaaatgcgcctttaactcgtcagtaagaagattagggtcgtatgcaacgattttttcaatacacttttcctctaatgaccatccatagaaccaaaaattaatagaaagtaccaacttctgcatatgaggagtgagctttcgtttttccgtttttaaagaattcaggtgcgcaatcaactgttgggtcaccatatttaaaggctctggttttgttaaaagaagaatgagtaggtcagagcttgcatattcttctactatagatcccagacgccttaaacaagcggtcaaagagtactttaccttgcgactcaagaaacgaggaagaaaaagattcttaatttcagagatgactcccctgagcaagctaccagaactcttagagctttcctccagagcgcgagggaagtcaacaattaacgttgtgatctctttttctagagactgcattcgctctgctatcggcttagaatagactttattctgatgataaaatgtactttggataacatagggcttaaaatcatcttctactattgatgggattttagccttaaaagaaacggtcttacgctctttgggaagactttgaccttcaaccggaacaggcttaagactttcagggtcttttatttcaaggtctttggtggggtctatcttttcttcgttagagggctcaattaagggttttcctcccttatacaaacacattagggaaacaatggccatcatggagcatactgaagcggcacacccccaaacaagaagacctagaggagcggcaagtacatgacaccctaccaaagcgaaaacaacacccagcaataaaagaaccgaaatggctaaaagacagagaatagtcacaggagacaatgagaaggactgattcttcctgtaaattaactcgtgacttgctgtggtctctttatttgcagtgaaaaaaaataaattaaacaattctttttaaaaaagttagttaagcaaaatcgacgaaaatattatacaaaactaattaaaaaagagaaagtttatacctccggctatcagaaaaaagattatcattgacataatatcatttagggctgtgacaatgggcccggaggctaaagccgggtctactcctagcttagcaaagaaaaatggggataaaacccctagagtcgtagctgtgagagaagctcccagaaccccagtagccaccgtaacgcctagttgaatacctcctccggagaagatatttaagcctagaaagcccattaaatagacaacaagaccacatagaatccctaaaacgactcctgtaagcagcccgatactcatttctttaaaaatggtctctcgacgccgtccgaaagaaagcgtccctgtagccatactccgcactaaaatagtgctacattgaacacctacatttcctgacattccgttaatcaaaggaataaagaagataatcagagctaaaagggcgggggaaattttttggaaatatgccatgacggaggcgctaatcaaacctgcaaatagagtcaccaaaagccagggagctcttagtaaaaatctttgcacaacatgacaggtctgataacccacatcttccgtagtacctgccatcctagctatagtctcatcagcgatgtcctcgatagcttcaacaacatcttcataagtaatagccccaatcaagaaattttcctcatcaacaaccggaagagcggcaattttatacctctctacaagatcgacgacctcttcacgggtagcatcaggaagcaccttatgttcaatctgattcataatttgctttaaagacatctcgggagggttaatgatcaaacttctatcggtaacgacaccttgcaactcgcctttaaaatccaaaacaaagaccaaacgagttaaatcaatcccaggattacttcgaatacaagcagaaacgtctttcaccgttgtttccatcaaaaaggcaaaaaactcattggtcattagccttcctgcagtatttcttccgtgtttctgcaaatcacgaatttttagtgcttttttagaatctataagctcaagaattctccgatacctacgatcggggatatcatctaaaacccataccgcttcatctggaggcatctgttcaattaaagcgcagacctcagaatccgacaacctacgaaaaatcgcccaccgcgaagcagaatctgtattgatgataaacgcaactttagcggtaatacaagagaggttcttatataaaatagcacgcgattccgagggaagacaggaaacagcataagcaaggtctatcgggttatactcaatcacaattttagaaagatcatgagaatgtatatctgtagaaagacaagtaaatgctttttctaacttaaaactcagctcgtcatctagatgactcgtcctggaatccatcaagttcccagaactaaaagctgtatctagtttctcttcatttcggttttgttccccaaccataatcttcccttttgattctctacaacttcacgaaatgcatggatttccctgaggttagctaaataaggatcgtttaaccacttggcttctgtaatacgaacgccatactgcgcagagcgaatgaccattccccacgccttgttcacatctttgatcactgcataaaactttcccaaagtataatacgcctctggacaccccaaagaagttgccttctctaaatatgttctagcaagcttacctaaacacacattcttatttttccaaaataggaataagtatacttttcctaacagtagtaagaaattctcatcttcaagataaacttcaactagaggttctaaaatctcccgtgcttcttcagccgggtctgtatcttgtagtaatcttcctttccccaacaaaaccgcagcaagaatcaatttaaccctagaggaggataaagtaagatctaccttagttaaaagtgtgtatgcctcatcataatgaaacaaactttgttgcagttcggcaagcaaataatgagattgtccccaaagttctaggatttccagtcgaccacttaaatcccacgctctctgataatgtaacagtgactctgataagaaaatttctttataagcttcatcgattgtggcttctgccaagcattttaatgctaatcctcgatcactccaaaataaaaaagcctctggacgcaaagaacataacctacttgctacatctacagcttttcgtagcaatctagcactttttttcttgatcccccaagaaaaatatgcatcaaataatttttgccacattcctgtcgcatccaaatcccattctaaacaagactgaaaacaagaaatagcagaagcaaaatgcgagtcctcattgaaataaagtgcggagcaaagctgcacaacaccaagagcatggactaacgcactattgccaggaaacgtcctcatagcagaaatcagcctgtgccgactatctttaaataaatttggttcttctaagtataaccctaaaatagcaatccctgtagctagtaaacctgaaagcgcaatgggatcattcgtctttttttgtaaagaagccagtttttctaaaccaacttcaatatacttcatattactattcaaccatcccgaacgaatgaggagctcaccccaaaccatccatagccctgaaagattaggaaacgcctgaacggtttggtaaaggatgttcatagcctgatcaaaatgctcttttttataagtcagatcgaataacttcacagaagcaagagcatagctataacgataattttgataggcaagggtgtcaccatccctgctgaaactcagaaaaatggctttagaaaaatgctccatccctctttctatgagcaaagactttccctgtctagttcctaaaactaccaggcccttagcatagtcagcatggatatgagcattattaggtgataaatctagagctaaggccagacatttcatgccgcaggccaaatcactcaattctaagtgcttgtggtataattctataaaactacggcccacagcctgatacacagaagcacttgctactaaagaaacctcttcttgcttagctcctatacggaagtgctcccatcctaaacgattcttcagttgaggatgcattttcaaaagctgttctattaaacggaaattatctacaacttcagagagaaatttcatctctcccgtctgagaataaagttcaaaattgatacaggttcttgcagagcacaaggaaagcctatcagaagcactaattcctaatttttcaaaaagaaaatctatataggtcaaaacatcaatgaaaatcgacatacttttatgttttaaaccataagagaccccatagaaaatcactctctttacaactttagggtgattgtgagtcatcattaatagagaccgagacaaagctaagtagccctcgctcggttcgtcttgttgtgccaataattcaatttcagagaaaaggaaatcaaccacatcttctggacaactgaactcatcctgcaagcccaacatatttaaggctcttttagaggaaataaaaggtaatggtgatctaatcatacaccttctttaattatcatagctaaatcaccttgaaattcatattagaaggtgttcttacccactaataaaaactagtttttgaaaagaattctaaaaaccttcttttaatcttttcaaaaacaagaacatctatttcttattgacaaagcacttcatcatttcatagcttcaaaactgagatcagtctatcctatttcatttttcaattaaaaatattttctatctctatagtgacagttatcccctttagaaaaggctgcccatcgtctttaaaacaaagagcctgtcactataaatcttgtttaaaactcgcaaaagactctaggttaaattcttttgatacttaaacaataaaatttttagcactgtcattccccgaatcagggatcacacttatatgtggatatctaccactagtgtcgagccctcgtctctcagggagctggattgagggatgggctccagaaacaatttctcctttatcaaaaaggaagacagattgtggctggcaacacaacatcaaataaaaagcatgctgtcctaaacctttacgccccccacctccttcaaatcggaataaggaatgagcctcattggctaaagatacagatcgcgcaagtatcacgttatcattccaatctctttctacactccccatcaatacacggcctgcaagagggtccaacaaactataaaaagctcctatcatacatgcagaagcataaaaaggagctttcaaaaaagcagcaagagaccgccccatctctcgagcaacatctttataaataaatctatcgtcttcgggaagatgtttacagaaaaaatgctcgtaaatcattcggaaaatgatataaaatggaaccactaaaaagcgtatcaaattgtaaatcattctaagcaaagctacaaaaggcatcgcacacggaattccaaaacaagggaatgcgcgaaataataatggtggacattgataaaccgcagctattccagaaccgtcagcactcagcgtcgatatatctagataagagcaagcactcacgtgcttttcatcgaatttttccaaagtatggctggaggatataggaacccaacaccgtctgctaaaaggtggaatacacacccctgaaattacatctactttcttccccagacgatgcagaatgtacatgcctccagtaagcaaaattgttgggataagaattgctgcagtaaccaaaggccaggaagtaattacaagtgtaccttgtatgctcgctaacattatactgaatagaatcaacacacccacgacagcaagagcgatcaccgtgagcctcacaaaaaggttcgcatcatatttattcactttacaaacagaaacggacagggtatcagatctatgctttcgcaatgctgaacgaaaatagctttgccatccttgtttggggaaagatgccttaggactaattggtcttaaactttcgtttgtagatgtaagattaaaacaagacataattacattataaaattttgctcggcattcaaacccaaagaaaagaaattcacgaattgttatacttatttaccaattaaaattttaatcgacttatgaaaaaacaacgctctcattataaaaaaaataatcttttattacttctttctatattggttggcctaggtttaggaagtgtgcaatccccatggattgtttattctgccgaatgcatagcaaatacttttctaaaattcttacgtttacttagcattcctttggtattctgcgctctcggctccaccattacttctatacaaaatttcaatactatggtgactctaggaaaaagaattttatattataccctgctgacaacagttatcgctgcttccattggacttctgctgttctttttactccgtccccaaatgataactcaagatgccctagccacaactacaaagtgtaatcccctaggatacttggatgtccttagcgacaccctcccagaaaatatctttaagccattcctccaaggaaatgtcatttcagccgcttgcctagcagtcctgctaggaaccgcgtccctatttcttcaagaaaaagaaaaacatttcgtaaatcaattttttaattcatttttttctatctttctcaacctggctagaggcggtctaaaacttctcccaatagcaatgctcgggttctctgtcatcttgttcaaagaattgaaagatcaaagcaaccttacaatgtttgccgagtatctgctttgcgttataggagcgaacctcgcccaaggttttattgttctccccatactacttaaaataaacaaagtctctcctttaaaagtcgcaaaagcaatgtctcctgcactagtgacagcttttttctcaaaatcatcggcagcaacattacccctcaccatggaacttgctgaagatgatttaaaaataaataagaatctttctcgatttagcttcccgctatgctctgtcattaacatgaacgggtgcgctgcttttattctaattactgttttgtttgttgcgacttccaatggtatgatcatttcgcctctaatgtctttaggatggatttttattgcgactctcgcagctataggaaatgcgggcgtacccatgggatgctactttcttactctttctcttctcacatctatgaatgttcctttatctatattaggtctcatcttacctttttatactgtaatagatatgatagaaacttctcttaatgtttggtctgattgctgcgtagtcagtttagcaaactaacaactctcaaaaaaactctcactataaaggagtgctttaaccatgaataaaaaacacgccagtttttcatctcgactaggatttatattctctatgatagggattgccgttggggcaggaaacatctggcgcttcccgagagttgctgctcagaacggaggtggtgcattcctaattctctggctatgttttttatttttatggtccatacccttaattattatagaactctctattgggaaactaaccaagaaagctcctataggggctttaattaaaactgcagggaaaaaatttgcttgggctgggggcttcattacccttgttaccacttgtatactcgcctactactctacaattgtaggttggggattaagctacttttattatgcagtttcaggaaaaattcacctgggaaatgactttgcaaaattatggacatcccactatcagagttctatccctctctgggcacacctcacctcattaggattagcctatcttgtcattcgtaaaggcattgtccatgggattgaaaaatgtaataaaatcctgatccccgcattctttctatgtaccatcgctctacttttacgagcagtgactcttccaggagccgttcaaggaatcaaacaactctttagttgtgataaaagttgcttttcaaactacaaagtatggatagaagctcttacgcaaaatgcttgggatacgggagccggatggggcctactgcttgtgtatgcgggctttgcctcaaaaaaaacgggagtagtgagcaatggagctctaacagctatatgtaataaccttgtttccttaatcatggggatcattatcttttccacatgtgcttctttagacattttaggaaccacgcagctacaagatggagcaggagcttcaagcatagggattacctttatctacctaccagagttatttacccgtttgcctggaggaatttatctaaccaccctgtttagctctattttcttcctagcattttctatggcagcgctttcttccatgatttccatgcttttccttctctcacagactcttgcagaatttggaatcaagccctacatttctgaaaccctggcaacaatcattgcctttgtcctagggatcccttctgcacttagtctcacatttttctctaaccaagataccgtttggggagttgcacttattgtaaatggcttgatctttatttacgcagctttagtctatggcttccctaaactaaagaaagaagtcattaacgctgctcctggagatctccgactcaacaaagcctttgattatataatcaaatatttactcccaattgagggaattcttcttttaggatggtatttctatgaaggactcttccctgaaaatggtcagtggtggaatcctatttctctctatagtctgggcagtttagtcctgcagtggtctttaggactcataatcttatggaagttcaataaacaactttatttaagattttcccgttacaatcacgaaattctataaatccaatcgataattctactctgaatattcagggtagaatcacagcattttggaaagaaaaaaatatttaaagattgaaaataacgtttttcctggcctagtatgtttggcattaatctatttttagataggaaaaacatatgtcagcacctataccaaccccacaagaattgtcagaccaaatcacctgcttaaatgtccaataccaacaggtatccgaactagcaagagaaaacaaaggagatattgaaggcttaaaaacactgactgcggctctaaccgctgatgctggcatacagccttcagctgatgaaatctactcattgcaaacagccgcagccctaatcttatctgcttccgaaaaacctggaagcggtccctctggaagtactgaaggatctgttactgttcaatctccatgcaaattcaaaaaagtactagcagtcgtattaacgataattgctttaattgcaattgctgtacttatagcttgtattattgctgcttgcggaggtttccctctacttctatcagctcttaacctatataccataggtgcttgcgtatcactaccaattatagcttcaacctcggttgcgcttatttgcttgtgcacatttgtagcaaactctctaattaaacccgtaattactgtccgtacaacaagataataagtaaaaaacacaaaaaatagtgattttatgacctcaccgatcccctttcagtctagtggcgatgcctctttccttgccgagcagccacagcaactcccgtctacttctgaatctcagctagtaactcaattgctaaccatgatgaagcatactcaagcattatccgaaacggttcttcaacaacaacgcgatcgattaccaaccgcatctattatccttcaagtaggaggagctcctacaggaggagcgggtgcgccttttcaaccaggaccggcagatgatcatcatcatcccataccgccgcctgttgtaccagctcaaatagaaacagaaatcaccactataagatccgagttacagctcatgcgatctactctacaacaaagcacaaaaggagctcgtacaggagttctagtggttactgcaatcttaatgacgatctccttattggctattattatcataatactagctgtgcttggatttacgggcgtcttgcctcaagtagctttattgatgcagggtgaaacaaatctgatttgggctatggtgagcggttctattatttgctttattgcgctaattggaactctaggattaattttaacaaataagaacacgcctctaccggcttcttaaaaaaataaattgaattagaataagtaatagtaattttcttcatacctcccttgcaattaatcactttgttcttataaaatgtcttcttttgcttgggtaggtatggagtatgcagagagttttgcgactgctgtttaacctacatcatggggaagaaaaaagggctttccttttttttctcttgggattggtctgggggataggttgttacggcactctctctctagctgaaggcttattcattgaaaaattaggatcggcagaattaccaaaaatttatttaggttcttctctgatcctttgcgttctttcatccctaattctttacaatctttttaaaaaacacatctcagcaacagctcttttcttaattcctgtttctttatctatcctttgtaatttttatcttattctctcttctatctttgctatcgatcccccccggtctcctctgtttttctatcggattgtaatttggagtttaacgattctctcttacacgagtttttggggatttgtagatcaattttttaatttacaagatggaaaacgacacttctgtatttttaatgctatcatcttcttaggagatgctatcggcagcggaatcatagctagcctggtacacacaataggaatccagggcatcctgattttatttacagcagccctggtcctgacattccctatcgtattctatgtttcaaaatctctaaagtcgctttccgatgaccatgaccttttcatagatacaggccacccaccacccttatcaaaagcattgaaactctgtttttatgataaatatactttttatctgctttgcttttattttctcatgcaattgctagcgattgctacagagtttaactatttaaaaatctttgaaattcaatttgcctctaaggaagaattcgaactcgtcgcacacataggaaagtgttccctgtggatttctttaggaaatatgtgctttgctcttttcgcctacagtagaatagtaaagcgtcttggagtcaataatatcattttatttgctccgctatgtttcttaagcctctttctattttggacctttaaaacaaccctaagcattgctgtccttgctatggtagtacgtgaaggcgttacctacgctcttgatgacaacaacctccaactactcatctatggagtccccaacaaaatccgaaaccaaattcgcatcgtagtggaatcctttatagaacctatcgggatgttggtctggtccttaatctgtttcttgtcttctcaacaatatgtgttctgcctaatcatctcactaatcgccactattctggtttgcctcgtacgctcttattatgcgaaggcgattctcaaaaatctatctgcacaagccctacaacttacccgctctatgcaagattggatcaaatctatgacagttaaacaaaagagacaagtcgaactcttcttacttgctcatcttaaacaccccagtgagcgtcatcaaacctttgcttttcaacatctcttaaatctagcaagccgcagtgtccttccaagcctccttgcccatatgaacaagctcagcctccctaataaactcaagactatagaaatggtaaaatctagcttatgggccaaagattttctaaccttagagctcctgaaacgttggacaagtattttcccccatcctgccatcgcatcagcaatacatctttattttgcagaacacgatctcctacatatcactcatattgctgaagacctctatgatactgttggtgatagacttcttgccgcaattcttacagtaagaagacaggaagcttatgggccctatcgagaccttgcagacaagcgcctgaaagaactactcaactcggatcaacctgaagatatagtcatggggttgaccatactgaaattagaaaagaatccacagaacttcccaattcttttagacttcttgaacaccaaaaacgaagatatcttaattgtcacctgcaaagccctacacacttctgttagagctaatcataaaccttattgccccgaacttctgaaaagactacgacaatgctcgcataatgatgaagcaagtcaatatctattaaaaacaattagcattgctttagatatctcattcgtaaaagacttactgatgacaacatcacaactaaaaaacacctctagaaaatatgctgaggctatgattggagagttggataaagaagtcgccccagcatttctccaagtcctcaccgatgagggaacacacaatcgttgtcgtatccttgccgccaaagccctctgtaaaatcgataattggctgctgaaaaaacacgcgtataaaattgtgaagtctaaagcaagtaaggctctgttctattcctatcacggccattacattcaaaagaaataccccacatacaacctcagcttgctggcaaacacattaaattctaattattatgcagaagtaaacttcatgctctctctcctagggattcttggttccatggagcactctggtgtactgattcgagcattaactagtaaaaaccaaaaaatcaaagcacaagcactagaatctttagaaaaaaactgcgatagccacttattctctttactagaaccctttgttaatcaaccaggcatgtgctatagcgaaaaatactacttcaaatgtggtgtgattcctctaactcttaaagaacttttaaatatgatggaaaactccccatcatctttaaacaaactaacagcacagcaactcaaagaagaactttcctattgcgatccagacttccaatctgtaaatacaatctataaccaagaacatgaagacttcaggacagaggaatcagaaaccctaatatctttcttatctatctaaacttcaatgattccaatttagatatccacagaaaaaccttgggaaactgaagatttaaaaaaaccaagattgatttataagtttcgactgcaagaaaaatcaatttcaacggttccttcttgaaactcttctatcttaaaggtaagatctacgtatcaagtattacatctgtggtgatattaaaatctttgattttaacaacactgattcttcttaaaccattgtggaggcttttctttaaactacctgcatcgtagttattgcttctatccttcccaaaataatacaatccatctcaaggatacgtctctgtgcctttacttttgtcaaaaactaaaactatggtgtgaataaggaacttttttatgaatttgatcgatcgcgcctttctactaaaaaaaacgattatattccaatctttagacatggaccttcttttaacaattgccgataaaactgaaacgataatatttaagcctggcagcaatgtattctctataggacaacctggattcagcttttatatcattgtagaaggatacattacgatctctaaagaaaaactagagtctcctctaaatttaaaacctttagattgttttggagaggaaagcttattcaataataagcccagggaatacaatgcttctgcaaatacacaagtccgcatgctagttcttagcaaaggacaaattctaaacattgtggaagagtgcccatccgtagctttatcttttttagagctctatgctaaacaaatcaagttcagagaaccttaaaaagacaaaataaatctttctagatgagctactctatagaaaaaaaggcacgccgtaatcactattgaaaaacaatagctttaaaaaagattacgacgcacccagaatataagaaagtttattgttcagcttgacgtttcttaatataagtaaatacatccccgacagtacgaagcttctcagcatcttcttctgaaatttcaaaagcaaatttttcttctaaagtcataatcaattctgttaaatctaaactatcagcattcaagtcttcaataaaagaagagttctcattaacttcttttggatccactcctaactgctcaacaataattgctattacatcatcttctaaactcattgcttatatccttttactatttaaactatacaatacttcactattccctagggacaaagagaaagagaattagtatcgcaaaaaatcattttttattcgacggttacttaattagttctcgaagagaaattttcaaatccctttcttctattgtcttagtaagtcaatcccccatcaacaaccagtgtctgcgcggtcatatagctcgataactgcgaggctaaaaacaacgccacacgagcaacatcttctggagtgccagccctacctaaagggatcgacttaagccactcagcttttaaattgtcattcaacacgcttgtcatgtctgtttcaataaagcctggagcaaggcagttgacacgaatatttcttgcagctacttccttagctaaagattttgtgaaagcaataatcccagctttagcagcagcatagttggtctggcccgcactaccgatcttagcaacaatagaagccacatttataatagatcctgaacgcgccttaatcatatggcgaatcactgaggaacatgtataatacaaggaagtcaagttggtgctaatcaccgattgccagtcgtcctcagacatacgcatcaacaaattatccctggtaatgcctgcattatttaccaaaatatctattttgttgtgcttatctaaaaatttctgcacgcaatctttcactccaccattatgactcacatccacacgagcaaaagaaacttcgccacccaagcctgttaaactttctataacagcctgacctcgctcctcattcaatccccaaatttctacatctgctccgttctcaagaaaaagcttaactatcccgagtccaattcctcgagatcctccagttactataacttttttgcctactaatgttatatccatacaaatcatacctctgataggaatttttcaatctgagcaaaagtaccaagacttgtaatcggtttagaaatccctatagagcgatttaaaccagccaaaacttttcctggacctaattctaaaaactcatccacctctgattcgatatggtaacaactctgataccataacgtaggtgatgtcatttgccgagctaaacactctcgcatttcttcagtatttactaaagattttcctaccacgtgtgacactaagggaaggctagaatctttcatgcataaagcataaatgtctggagctaagccatcttgagcaacttgcattaaaggagtatgaaatgctccagacacctttaaacgaactgcttttttacatcctaaatcacgaaataactcaatcgcttggtctactttttctgctattccagccactacaagctgtttgggtgcattataattagcaatccaaattccttgaccaagacttgttatattttcctctataacttcagagggaagccctaataaagccgccatagcccctgggctctgattacaagcttcattcattaactgaccacgctttctaacaagctcaaggccgtcgagcacggagattctatcggaagcaactaaagcagtatactcccctaaacttaatccagagactaaagaaggctgaatagaagaacgctgagatagaacctttaccacagccatgctatgaagataaatagctagctgactatgtactgtttccatcaaaagatcctcaggaccttcaaacataattgaagtcagagaaaatcctaacctttcattagcaaaatcaaaaagctctctaacctcaggatactccatatataggtcttgtcccatacctacatattggctcccttgtcctgggaacaaaaaagcataacgttttttcatgaaattatcgtccttattagacctgctttaaaactactgcgccccaagacaaaccgcccccaaaggcaactaaaagtaaataatcatcaagcttaatggattctgtatgaactaattcatccaaagcaatgcccacagacgaggccgcagtatttccatacttatgtacactcttaaacactctagactcatcaatctcaaaacgcttcgctaaagcatctattattctttcattagcttgatgaggtacaaaccaatctatatcctcttcctgaatgcctgccagggctatcgaatgtttagctgccgtttccatacgtctcacagcatgcttaaaaacttcttttccctccatagcaataaaatgtttgcctgattgtaaagtctctttagaagcaggacaacgactacctccagcaggaaggcttaataactctcctagcttaccatctgcgcctaaagacaacctattaatctctaaagatcctggccgactctcccctatgacacaagcagctcctccatctccaaacaacacacaggtattccgatctgtataatctacaaaagaagacaacttatcagcagcaattaacaatacatggttatatgtacctgattctacataagccttagctacagacaaaccatacaaatacccagtacaagccgcctggcaatcaaatgtagggacatcctcaatgcctaaatgtgcttgagcaagagctccgcttgatgggaaaatataatctggtgctgctgtcgagaaaatgatacagtcaatctgatccttgcttaaacccgcatttgctatagctttctctgcagcgatggctcccataagagaagtgtactcctgaggtccagcaatacgacgctctttgatccccgttctggtcacgatccactcatcagaggtatctaccattttttctaaatctgcgtttgaaagaactttctcaggcaaataggaacccgttgcccaaattgctgcttttttgtttttattcacagagaaccacatgtaaagaaaaaagctagtatactattcagagagtttatactctaaccttaatttaggccccagacccgaatgtaaaaataaaattcacatcactatgacaagatatccagattacttatctaaattaattttctttttacgaaaacttccaggaattggatttaaaacagcagaaaaacttgcttttgaactcatctcttgggacagcgaacaattaaaaatattaggtaacgcttttcataatgttgctagtgagcgtagtcactgtcccctatgttttactctcaaagaatctaaagaggcagactgtcacttttgtagagaagaaagagataaccaaagtctatgtattgtcgcttctccaaaagatgttttctttctagaacgttctaaagtattcaagggacgttatcatgttcttggttcactcttatcgcccattacagggaaacatatagaaaacgagcgtctctccattttaaaatcacgcatagaaacgctatgcccaaaagaaattatcctagccattgatgcaaccttagaaggagatgctactgccctttttctaaaacaagaattacaacatttctctgtaaatatttcccgtctagctttaggtcttcctataggcttatcttttgattatgtagattcagggacactggcaagagctttttctggacgacactcctattagcagctctcttatcctaaaagtaaacaaggttctcttctatgctagtctttcttactttcccctaggacacagtgaattatcgaatttgccttaaaaccatgtaatcagtagagttatttgagcgacaaggtttattaagctttttaaggaagcaaaaaacccgccgaaatattcaggctctagtctgagcacagtaataatcccggtgttaggacgggaaaaaatcaaacacaatttaaatttctttagaaatacaaaaataatctaagtagtaaggtcttgttaaaaaacttctttgtccctatttttgtgcttacctcattatctgataaacaagctttctatctagggaagactcttgggaatgctcatcatgcgaaataaagttatcttgcaaatatctattctagcgttaatccaaacccctttaactttattttctactgaaaaagttaaagaaggccatgtggtggtagactctatcacaatcataacggaaggagaaaatgcttcaaataaacatcccttacccaaattaaagaccagaagtggggctcttttttctcaattagattttgatgaagacttgagaattctagctaaagaatacgactctgttgagcctaaagtagaattttctgaagggaaaactaacatagcccttcacctaatagctaaaccctcaattcgaaatattcatatctcaggaaatcaagtcgttcctgaacataaaattcttaaaaccctacaaatttaccgtaatgatctctttgaacgagaaaaatttcttaagggtcttgatgatctaagaacgtattatctcaagcgaggatatttcgcatccagtgtagactacagtctggaacacaatcaagaaaaaggtcacatcgatgttttaattaaaatcaatgaaggtccttgcgggaaaattaaacagcttacgttctcaggaatctctcgatcagaaaaatcagatatccaagaatttattcaaaccaagcagcactctacaactacaagttggtttactggagctggactctatcacccagatattgttgaacaagatagcttggcaattacgaattacctacataataacgggtacgctgatgctatagtcaactctcactatgaccttgacgacaaagggaatattcttctttacatggatattgatcgagggtcgcgatataccttaggacacgtccatatccaagggtttgaggttttgccaaaacgccttatagaaaagcaatcccaagtcggccccaatgatctttattgccccgataaaatatgggatggggctcataagatcaaacaaacttatgcaaagtatggctacatcaataccaatgtagacgttctcttcatccctcacgcaacccgccctatttatgatgtaacttatgaggtaagtgaagggtctccttataaagttgggttaattaaaattactgggaatacccatacaaaatctgacgttattttacacgaaaccagtctcttcccaggagatacattcaatcgcttaaagctagaagatactgagcaacgtttaagaaatacaggctacttccaaagcgttagtgtctatacagttcgttctcaacttgatcctatgggcaatgcggatcaataccgagatatttttgtagaagtcaaagaaacaacaacaggaaacttaggcttattcttaggatttagttctcttgacaatctttttggaggaattgaactatctgaaagtaattttgatctatttggagctagaaatatattttctaaaggttttcgttgtctaagaggcggtggagaacatctattcttaaaagccaacttcggggacaaagtcacagactatactttgaagtggaccaaacctcattttctaaacactccttggattttaggaattgaattagataaatcaattaacagagcattatctaaagattatgctgtccaaacctatggcgggaacgtcagcacaacgtatatcttgaacgaacacctgaaatacggtctattttatcgaggaagtcaaacgagtttacatgaaaaacgtaagttcctcctagggccaaatatagacagcaataaaggatttgtctctgctgcaggtgtcaacttgaattacgattctgtagatagtcctagaactccaactacagggattcgcgggggggtgacttttgaggtttctggtttgggaggaacttatcattttacaaaactctctttaaacagctctatctatagaaaacttacgcgtaaaggtattttgaaaatcaaaggggaagctcaatttattaaaccctatagcaatactacagctgaaggagttcctgtcagtgagcgcttcttcctaggtggagagactacagttcggggatataaatcctttattatcggtccaaaatactctgctacagaacctcagggaggactctcttcgctccttatttcagaagagtttcaataccctctcatcagacaacctaatattagtgcctttgtattcttagactcaggttttgtcggtttacaagagtataagatttcgttaaaagatctacgtagtagtgctggatttggtctgcgcttcgatgtaatgaataatgttcctgttatgttaggatttggttggcccttccgtccaaccgagactttgaatggagaaaaaattgatgtatctcagcgattcttctttgctttagggggcatgttctaagatataaattaaggacttatcgaaggaaatctttgttgttttcagaaaaggcttttggtaccctttttctatacccaagttagtacaggtaattatgaaaaaattattattttctacatttcttcttgttttaggatcaacaagcgcagctcatgcaaatttaggctatgttaatttaaagcgatgtcttgaagaatccgatctaggtaaaaaggaaactgaagaattggaagctatgaaacagcagtttgtaaaaaatgctgagaaaatagaagaagaactcacttctatttataataagttgcaagatgaagattacatggaaagcctatcggattctgcctctgaagagttgcgaaagaaattcgaagatctttcaggagagtacaatgcgtaccagtctcagtactatcaatctatcaatcaaagtaatgtaaaacgcattcaaaaactcattcaagaagtaaaaatagctgcagaatcagtgcggtccaaagaaaaactagaagctatccttaatgaagaagctgtcttagcaatagcacctgggactgataaaacaaccgaaattattgctattcttaacgaatctttcaaaaaacaaaactagtccaagtttaaggagttttctatgtccgaagcaccagtctacactcttaaacagttagctgagctactacaagtcgaagttcaaggaaatatagaaactcctatttcaggtgttgaagatattagtcaggcgcaacctcaccatattgcttttttagataatgagaaatactctagctttctaaaaaacaccaaagctggtgctattattttatctagatctcaggcaatgcaacatgcccacctaaagaaaaactttcttattaccaatgaatccccttctctaacatttcaaaagtgcatagagttgtttattgaacccgtaacatcagggtttcctggtattcatcctactgcagtgattcatcctactgcacgtattgagaaaaatgtaaccatagaaccttacgttgtcattagtcaacatgcccatatcggctctgacacatacatcggagctggaagtgtcattggagctcacagcgttctaggtgctaactgtctgattcaccctaaggtggtgattcgagaaagagtcctcatgggaaaccgtgtagttgttcaacctggagctgttttaggatcctgtggttttggttatattacaaatgcttttggtcatcacaaacctttaaagcatctaggctatgtgattgtaggtgatgatgtagaaatcggagccaacactacgatagatcgtggtcgattcaagaacaccgtgatccatgaaggaactaaaatagataaccaagtacaagtagctcatcacgtagaaattggaaagcatagtattattgttgcccaagcaggcattgcaggttctacaaaaattggtgaacatgtcatcattggagggcaaaccggaattactgggcatatttctattgcagaccatgtgatcatgattgctcaaactggagtcacaaaatctatcacctctccaggcatttatggaggcgctccagcacgaccttatcaagaaacacatcggttgattgctaaaattcggaaccttcctaaaactgaagaaagactaagtaagttagaaaaacaagtaagagatctatcgactcccagccttgctgagattccttcagagatctaaaattctatttattttattagttttgaaatcaaaaaaaagaccaaataattaaatatataaagaacgtactcttctttttatcatgagaattttcatgatatttttatttaaaatttctgggctaatcttccctgtccgcaatagttgcatgactattttcattccaagattgaattcatccagattagaaaagataaaacattctccgccagagtttaaagcttttgcagtgtgctctgtattggaaagtatagacgggcttataaacttcaatgaagaaaaatctacatgtaaagcaaggccccgaattgtattcgctaagctatatctcaacgcaataggactcgatgaaactgaaggtaaagtaggcacatcattatcataaatacgtgcttgaatatttccactacgcttgagtccttgaattagtttcacatagtttaataaatctatatccacaatctctttaaaaattaaagtgaaagcaactccatgttgctttaaaacatccccgagctccttgcctagctcactcatgctctgacaattcaaaagagagatattcctataggttaaataataacgtagactatttacaacggtagttcctaaaagaagcggtaggtctagctttttattcacagtaacaacatgctcacactgttgttcgaataatccgcaacacagtaaaacccctcccaaacctatagaatcatttaaatgacaaattacttcggtaaattctacccagtcgctactacatccgggagaataaaaaaataactgagctatttttttatccatcgaagttaacatggcaaacaattccttagtttgctccaactcttcatttttgaatggcaaccattgagttttttttaagtagtagtttttagagtccgtcttacgattctgaaattcttgagcagaagcaacaatacgttttgttatagttaaaagcttttcctctaattcttcatgatctcgagatttatcttcactaggcttatgatcaaagtttttgatgacaccgtctatcgaatccacgtaaaactgagtgtgtcgattaattttacgagaaacgtccatgtgatgtaatcctttttgttctctttaaattgccacgagaaacatattaaaattttttcgattttttaaaaaaacttaattattttttcttcggatagcccttgtcttttgaaacctaggctcctataatgagatcaaaaaccgctcccgaagcgtctcccttataaaaaagttatggatagttcagcaccttataatatagcttctcagggcacagagaaatccacagtagaaaggatcttagacctttacgggcccgcttcctgtattaaatttttaaaacagatggttctgattcgtgaattcgaagcccgaggagaagaagcctatctagaagggctagtgggtggattttaccactcttacgctggccaagaagctgtagcaactgctgcaatcgcaaacacaggactagatccctgggtgttctcttcataccgctgccacgcacttgcgattcttctcaacattccccttcaagaaattgctgctgaacttttagggaaagaaactggatgcgctttaggtcgtggaggatccatgcatatgtgtgggcctaatttccctggaggatttggtattgtcggaggacaaattcccctcgcagctggagccgcatttaccatcaaatatcaagaacaaaaaaatagagtttctctatgctttatcggagatggtgcggtagctcaaggtgtattccatgaaactctgaactttgtttctcttcaccaactccctctaatgcttattattgaaaataacggctggagtatgggaacgtcattaaatcgtgctgttgcaaaacagcccatagcagagtctcaaggaagttcctacgatatccgtgcagtcacagtcaatggttttgatctatttaactctcttttaggatttagagaggcttatcgctatatggttgataccgaatctccggttttagttgagtgtctctgctcccgatttcgagggcattctatatcagatcctaatttatatagatcgaaagaagaaatgcagtgtttatttaaaaaagatcctattgtcctagctaaagattggctaattcgattagaggttctgactgaagaggaatttcaaaatatacgccaagaatgcaaaactgctgttttagaagcgttctctaacgcaaaactctcatcagatccatccgtcaccacattagaggaaggagtctatgcctaaacataaaacattagaaattcgagaagctctccgagaagcaattgacgaagagatgtctcgcgatcctaatgtctgtattcttggtgaagaggttggtgactacaatggtgcttataaagtcaccaaaggcttattagataaatggggccctaagagagtcattgatgctcctattagtgaagcagccttctctggaattggaataggagccgcattgtcaggcctgcgccctattatagaatttatgagctggaacttttcctttgtagccttggaccaaatcatttctcatgcagctaagatgcattttatgactggagggaagttttccgttcctatagtttttcgtggccctaatggtgctgcagcccaggtatcttgccagcattctcattgcgttgagtcgttgtatgctaatattccaggtcttattattatagccccttcgaacccttacgacgctaaaggcttattaaaatcagcaatcagaaataataaccccgttctttttttagaaaacgagctagaatataacttaaaaggggaagtccccaccgaagaatatctcgttcctattgggaaagcacatagagttcaagaaggaaatgaccttacaattattacttatagccgtatggtttccattacaaaagaagcgtgttctctagccaaaaaacgttggggcttgtctatagaaattattgatctaagaacgatcaaacctttagacatatcaacaattttatcatcggtacgaaaaacttcacgctgtattgtaattgaagagggccactacttcgctgggatttcttctgaaattattgccctgattactgagcatgtttttgattctcttgatgctccccccttaagggtatgccaaaaagaaacgcctatgccctatagtaaaatcttagaacaggccactttgcctaatgttaaccgaatcttagataccattgaaaaagtcatgaggtaagtttgtgatctccttattgaaaatgccaaagctttctccaactatggaagtgggcactatagtgaaatggcataaaaaaagtaatgatcaggtcagttttggagacgtcattgtagagatctctacagacaaagctattttagaacatacagcaaatgaagatggctggattcgtgaaatcttacgtcatgaaggcgagaaaatcgttataggcacccctattgcggtactctctacagaagccaacgagccctttaatctagaagaacttcttcctaagacagaaccttctaaccttgaagcatctccaaaaggttcttctgaagaggtctcgcctgcaacaactccacaagctgcctcagcaacattcacagcagtaacttttaagccagagccacctctctcctcgcctttagtcttcaaacacgtaggcactacgaataatctctctccattagctagacaactagcaaaagagaaaaacatagatgtctcatcaattcaagggagtggtcctggaggacgtatagtaaaaaaagatttagagaaagctcctcctaaaagcattgctggttttggctatcctgagtctcccgaagtgcctccaggttcctatcatgaggagaatctctctccgattcgggaagtgattgctgcacgcctacaagctgctaagatctctattcctcacttctatgtaaggcagcaggtctacgcctcacctctccttaatctgctcaaagaacttcaagctcagggaatcaaactctctattaacgattgcattgtacgtgcctgtgctctggcgctcaaagagttcccttctatcaattcaggatttaacagtgtcgataataaaatcgtccgttttgatactatcgatatctcgatagctgtggccattccagatggaattattacgccaattatacgctgcgcagaccgtaaaaatctcggcatgatttcagcagaaattaagagcttagcgttaaaagcaagaaatcaatctcttcaagacactgaatacaaaggagggtccttctgtgtctctaacttaggaatgacaggaatcactgaatttacagcgattgtcaatcctcctcaagcggcgattcttgccgtaggaagtgttacagaacaagctcttgttcttgacggagaaattactataggatctacctgcaatcttaccctatctgtagatcatagagtgattgatggttatcctgctgcgatgtttatgaaacgattacaaaagatcttagaagctccggctgtcctactattaaactagcaatctttgaacaaaaaggactctttctatagctccttggctatggaaagagtccctgattccatcctgtctatttcttaatttccttctccagagcaagattttgtaggaacatgccaaatatctctggcataatcctgaatggctctgtcactagagaaaaagcccattcctgcagtattataaatagaaatcttagtccatgaatctggttccttaaagagtttgttcacattttcatgggcagcgatataagactccaagtcagccaagacaaaaaagggatctccttcatgcagtaggcgatgtactatcggtttaaacagatctttatcattgctattgaaaaatccctgttctagcaaatctaaaacctgacggatcttaggattcttatcacaaattgtctgaggacagtattccctccgcagttgtacaatttgctcctccaaaagaccaaaaataaacatattctccttaccaatatgctctgccatttctatatttgcaccgtccatagttcctatagtcagagctccattcaaagcaaatttcatatttcctgttccagaagcctccattccagctgtagaaatctgttctgaaagatctgtaccaggaatgatatgctcagccatagaaactcgatagttaggtaaaaaaagaaccttaagcttatcattaactcgagaatcttgatttacaacgtcagcaacgctattgattaacttgataatgagtttggccatgacatagccaggagccgccttaccagaaaaaattactgttgtagggacgacatcttgattagggttttctttcaagtcattataaacatagatgactctaagaatattcattagttgtcgtttatactcatgaatacgcttaatatgacagtcaaagagagaattagggtctactatttctccaacttcattataaattctacttgttagatcctgcttattttttaattttacccctttccaatgatctcggaaaccactatcttcggcaaaggaacggatcaatgaaagatgagaaagatcaatgatataacgatcccctatagtttcattgagaagcttactcaaacgaggattacagagagcaatccatcgtcgtggagtcaccccattggtcacattgataaacttctcagggaaaaactcataaaactctttaaagagagtatctttaatcagctgagagtggaatgacgaaactccatttacttttgcagaacctactacggcaaggtttgccatattgatacgcttttgatacccttcttcaacaatggataaagaccggcgcttatcatcatttttaggatagcgagagccaactttttctaaccaacgggaatttatttcataaataatctctaaatgccgaggtaataacttagagaataaatcgagaggccatctctctaaagcctctgggaggattgtatgattggtatagttaaagatgactgtagtcatctcccaagccttatcccaaggtaattcttccctatcgactaaaatatgcatcatttcagcaatccctaaagcgggatgggtatcgtttaattgtactacgactttatccgcaaggttatccaaacaaatatgtgtctttgtatatctgcggataatatcttgaatggttgctgaaactaaaaaatactcttgtttgagacgcaattcctgcccctcagtaatagaatcattaggatagaggacgcgagagatgttttctatcaaggcgatatcttctatagcctggatatagttcccgtggttaaaatagctgaattcaaagcctcgcggagattgtgcttgccatagccttagagaatttacagtatcattaccgtacccaggaatcggaatatcataagccatcgccaatacctcttgggtatcgacaagatctgccacctgtttccctcgagaatcggtataatgaatgacccttccataaaatcgtacgggatagaggtactctcccctacagatttcccaaggatttccataacgtagccactcgtcaggagcttcctcttgatacccgttgacgatcctctgatcaaaaataccataatcatagcgtataccgtagccgtaggctggaactgctaatgtagccatagaatccaagtaacaagctgccagtctccccaaaccaccatttcctaatcctgcatcggattccatttctacaaggtggtcaaagtcataatttaaagtttttagtgccttccttactaaatctagaattcctaaattcaaaagattgctttttagacttctccctaagagaaattccatggaaaggtaataaactctttttacatcatttttatagtagccattttgagttttcagccaccccttggccaaccattccataacagtttttgcaacagctgtgaagatatctctaggagatgcggactctggtgattgtacaacacttaaatacagacgatctaaaatcgcccgtttcatagagtcaacactgactttgttcttatcaaaactcgaaaaatcttccacaatgcaaccatttcaaataccatctagaaccctccatatgcgaaatttgaaaaaaaaaaaagaacttcgccttggtaaataaaagagagcctattaagagagcttaatagttctgaactagagaaagactataaataaaattagttgataaattttaataaaattaaaataatatctataaaaatattattgacaacaattatatagacagattaaaattatttaattttttactcaggagaacaacatggctacagtagcacaaacacctcagactacacaaccacaaccatcagtatctcacaaggcaacacatcgttattgttcctgggtattttttaagcctattttagttagtctaggtctcctccttgcttccttaaccaccctaggactggttattgccagtggagtcaccctatccttaggaatcggcattgttcttgctatacagatagtacttgctggtattgctcttgtccttgctttcaatcatattagacaatttaaacaagctagaacagcggagttgaactcaatgaaaatgatatctgcgccggctgctgcaactgtccagaagcaaaaattagaggatcgttactcctctaaataatcatctcttcgctagggaaaaattccaaactcttatgcaaggaatttaaattcttagaaatatcttgaatagccatgtgaatatcatggctattttcttctattttttgttcaatcaatcgtatggatgagattaccgtcgaatgatctcttgaaaagacatcgcctattctcacgtatgatagtgaaagcttctgacgacaaaagtacatggctacctgacgtggcaatacatattctcgggactgagaacgtcctaaaatactctcctgagagaccccataatattgagcaacattacgaataatctttaaaggagttaaacgaacgcttcctgctgcttctaaaacatcttttaaaagagttttcacatcatcttcatatagtaattggtgagagagttttttatacattaccctctttgctaaaagattcagtgcatgcagtaaggtctttacgttggaagatagcgcataaattaaaaaatctaaggccgtttcttgaatgcgaatagataagcgctctacctgtctcattaagaaactgcgcaatccttcctgaaccaaaggatgtatcggaattgcaactccccattcaaacctgctgatcaatctatcttcaacagcaacgagatccacaggcgcataggatgaagacactacaatcaacttcccttcagaatgaagagaattaaacgtatggaagaactcttcttgagttgccgactttcctgaaaaaacctcgatatcctcaatgaatagagcatcaatattgcggtaaaaagaacggaatttttgcatttctcctgaacggatagcagagactaagtgctctgtaaacaaatccgaagaaacatagagaatcttacctccagattcacgaagaacactgatagctgactgcattaagtgagtttttccagatccctcaggtccaaacagataaattggattaaaagtaactcctccgttttcatcaggactcttagtaaattcctgtaaaacacgaaaaggaagatcattttcaggggtaactaaaaaattagagaaggtcatctcaggattcacacttccataatgcatggtaaagtatgctgtcttctcttgctgcatctgcttctccttataaaaaggagctgctttatctaccgaagtaacgtgaacacgaatgggcttattgttattatttacaagaccagatttaaccttatgtcttatatgctcctcaaaccaagtaatttgaaaagaatcttgagcttcaagatacaaattacaagcatcaaaacataagacctttaaagatcgcaaccacttgtctacagtatttgtgccaatttctttctcttgtagcaaaagaaattcttcccatgctcgcataaactatgagctcatataaatcgcttgtttcaataagcctgtattaagacaattcgacttttttttcagtattatcgatgttttttattatttaaaaccacttcatttttaagatgtttgctatctaatatcttattagtgatccactgctggacgactcctaaaatcatagacgaaagccaatagatgtttaatcctgaagggaagttatagaacatagcggtaaataaaatcgccatcatgttccccataacttgttgctgtttctgctgatccgtaacaggtcctttcttatgcaaactcgtgaccttctgttgtaagaacatcactatacctaatagaataggaagtaagtggaactcatttccaataaaccatatcgatgtctgccaagaaaacaacacatcaggagctgttaagttatcaatccacccaggaataaacgaggctcctcgtaataagaatgatgactttaataaatcaaacatcgcaattaggaaaggaagctgtatcaataaaggtaaacaacccgtgataggattcactttgtttgtcttatacaagcccatgatttccatctgagcacgcttaggttcgttcttatacttttgctgaatttgctgaatataaggagataaaatctgcatacgcctcatagatcgtatggaccatgcatttaaaggatagagaagcaatttcaaaaatacagtaagtaaaataatggaaattccccaagaacccgtaaccaatttgaagaacttcataataataaataggagtgctgcaaaaggagctgtaataaatgcaaaaacaccacggaaagaaatgctatcaagatactcaggattttctcccttctcctgagtaattgtcttatctaatactttaagtgtaggctctgccaagggacctgcatacactaaaaatcgatgtgtccctgcatcttttggcaaaggaagcaaggtctcatatccaggatattttgatactggatacagttgatttttaggagaaatagcagacaatcttgtcggagccgtagaacccgaaatgtagagagatccatagccagaagcaatttcagacaacggagttaaaataataccgaaatatccattcgaatttaaaatccattgaggataaacaccacgacgtatagctaaaggctcttttacttttggaagcttaactttatctaaagaccccttattttttttgataaccctgtatttaatggttggggctgaagcatttgacatgatctccacttcaggaactcctgaagttacccatacatcttcggtttctttcgttaaagtaattgcagtttcaaaaacatagggcttttcttccggattctctggaagtttgtataccttctgaaccgatctatctaagctttccaattgaatggaatggggggtataggaaagaactcggtatcttaaagccacaggagtcgctagctctcttcctgaaaccacatttaatgcgtgatactctagaggaagtaatttcttagaatcacttaataatcccctgcgcaataaagggtagtaacctccaatcgagtttttggcttgttggccatcaggaagttttgaagacagcccagggaaaagagcttcaggagatttctctgaagctaaatccctatcaaaaccaatttcattcacaatgcttttattatttgttgaagcaaaaggtaaattgataccttctatagaaccactctcttcagaaacaataatctgcatgtaatcattaaataaaacatagtggttcgcagtatctgacgactttgccgaatcttggtcattaccaaaaattacagctcgtgtaataggaagatccaaagaaactaacttttcttctcgagaatcatagagacctaaaggaatatagtcgcttcctgatctccaaaagacaagcgctgtaccaaagatcgtgctatctttattggaaattcttccttgtgcgtactcacctagaaatactaaaggctctttattgttacgaaactcaacaactagtacaggtaaaccttcatgattcgtaggaagaaaaacttttcccgtattcgtaggattgaaagaagaaccctgctgacgatataaagccaagtgaatattatcgaaaccacacttgtgatctacaaagctccaagattccccagaagaataaacagactgagcagcttctccattatgtaataaaaataacttgtctccaacacgaactgcgtagttattcttatgttcttctccgtttacatcggtgtcccatgaagctacacttaaccctacagattctactgcagctagcgtctgttctgaaatctttctttgtttctctgctagatttttgcaggaacgaaattcattataaccaaaaaatatttgacatcctacaaaagcaatcccaattaaagaaacaaaaagcaaagtgcgtttattcatttgataaactctaaaaattaaacttaagaggtcaaaatatcataaacccacattatctcccaaaggagaatctctcaatacaggtctcttattgtgatagactgtaaaattctaaagtctcatgccaaaaagatgctgctatatgtgtgaacggtgccttcgagctttcaatgagcaaatgataagtaaggccacaccaaatagaaataaaggtatagataaaatttgaccaattgtaagtagacaatcctctgctaaaactttcccttgatggctttttacatactccgcaaaaaaacgaatgaaagcgacagaaatacaggctatagaagtcacatatcccttacctaaatgcaaataacgcttataggaaagaaaatataaaattccagagacgaccaagtaactgattccctcataaagctgcacaggatgcacaggaactccctggacaccttgcataggatcagaaaaaaccaccccccaaggcaaagaagtcggtgttcctacaatttcttgattccaaaaattacccaaacgaataaaaaacgctgcaattccgaaaactgatccacacaagtctgtaaggaagagaaaagtcaattttgaaatcttttttttatatatccaagaaaaaatggccgcccacaaaagaaagccaagaacgcctccatgactcgacaagcctccgtgccatatttgaatgatctcttcaggatgttgtaagtaaaaactccatccataaaaaatcacataggcaagtctagctccagggacaataaataaaatagagtatataaaaaagttttctaaagccacgcgtagctggcttttggaaaaacttaaatgatctttcaaaccataataggaaagagccaaataccttgctgagagacatgctagaaaaatccctacagtaaaaaagacgccataccaagtaagtcttagagaccatggctcgaaagaccagacaatttttgagcgatcccaatagatcacagccatctcagctcgcatatcttaataccagttagcaaaaaattcatactccaagtaaaatagagtatttagaaattaagtgtaatgcactatggcaagaaacatcaaatatttcctgatactatttcctggtattttgtggatatcagcaggaatgaaactcttgctaaaagctaccgcaatagccctagaccccctttcttctttttttacctactgtcttctatctatggtttcttggggattagcatccctaaaacatcgctacttgctaagcaaaactataaggaaacagctgagtctatcttctgaattcttttcacaaaaaattacatggattgcctatataaagcagacctttatctctagaaggtttctcatcatggtcattatgattgccttctctttagtccttcgtcgttatatcagcaatcctcaagccttattcgtgattcgagctacagtgggctatgctctcattaaaactgccatcgcttacttctcaaaattacagaatgccctaatggaaaatcctgaaggaaattagtgcgaactctatggaaatcattcatataggaaccgatattattgaaattagccgcattcgcgaggcaattgcaactcacggcaatcgactactcaatagaatctttacagaagcagaacagaaatattgcttagaaaagaccgatcccatcccttcatttgcaggtcgctttgctggaaaagaagctgtagcaaaagctttaggaactggcatagggagcgttgttgcctggaaagacatcgaagtctttaaagtatctcacggacccgaagttctcctcccttcgcatgtctatgcaaaaattggaatttctaaagtcattctctctataagccactgcaaagagtatgccacagcaactgcaatcgcattagcctaagaatctttcagcatctagtgctgctatacaaccacttcctgcagaagtaaccgcctgacgatagtacttatcctgaacatctccagcagcaaatactccagggacagaagtcttggacgttcctttctcagtcacaatatagcccgactcatctaacgtcagctgtcctccgagaaaatccgtatttggcttatggcctatagcaaagaacacccccgcagcttctctagttgtaatttcttgagtctgaacattcttaatatctacggaacggacaatgctatctccagaaatttttacaatctcgctattccataaaaatgtaattttttcattgttttgcgcccgagcttccatagctttagaagcccgcagtttatctctacgatgaactacatatacgtggcttccataacgagtcaggtaaagagcttcttctaaagcagaatcccctcccccaatcacataaagatctttatttttaaaaataggagaagccccatcgcaaacggcacaagcagtcactcctttttgccaaaattcatcgtttcctgctccaggaatttctaaacgtttagcagaagctcctgtagctatgatacaggcatcacaagaataggtttcttcttttgatttcaaaataaaagggcgaacagaaaaatctacggaaataatatcttgagctagtgtcttggtcccaaaccgcacagcctgctccttcatattattcataagttttggcccaagaatcccttcaggaaaccctggaaaattctcaacttctgttgtagtcataagctggccaccagagatcccagagaaaaacccctcaaataaaagaggatgcaaaagcgctcttgatgcataaattgccgctgtatatccagatggacctgaaccaataataattaaccgggaatgaatcatttataatttccttatctaactttagaaattgagaacactgttcttgatctactagaaaaaagacacttaattctagcctatctaataaacaacacttagcgtctatgcgtcagtttctctatgcaaaaaacttgcttttgaatagcttttgtctagttttaatttatacggatttaagactaaagtttcaaatctcaagatcttcatcttccagtaataacacctacatttctgtgattaatctttagaattttcttagagctaagaaaccaagacccatcctattatttaaccctcaataagtatggttctacttctgaatgcacttggttcttgagcagcaaccaaaaagatctatcaggcttaagaacaaagctgatgtagcccatctgggacgagaatttatggggtgcttatgaaaaaaacgatatgttttctatgcgccaaatcctgtttctctacatatgacaaggcacatttatgataattaccacacgtattttataaaatctggtaatatagaaaagttaaaaaagaggccttatacatctctagaacggaagtataggattttacgattaattcgattatatagaactaatcgtctcctgcaagggaggtcttgccttttttaaggtttatatttacactgtcttttttgactttgtagtttttaggagaataacaataaatgccaaaacaagctgaatatacttggggatctaaaaaaattctggacaatatagaatgcctcacagaagacgttgccgaatttaaagatttgctttatacggcacacagaattacttcgagcgaagaagaatctgataacgaaatacagcctggcgccatcctaaaaggtaccgtagttgatattaataaagactttgtcgtagttgatgttggtctgaagtctgagggagtgatccctatgtcagagttcatagactcttcagaaggtttagtgcttggagctgaagtagaagtctatctcgaccaagccgaagacgaagagggcaaagttgtcctttctagagaaaaagccacacgacaacgtcaatgggaatacatcttagctcattgtgaagaaggttctattgttaaaggtcaaattacacgtaaagtcaaaggcggccttattgtagatattggaatggaagccttcctacctggatcacaaattgacaacaagaaaatcaaaaatttagatgattatgtcggaaaagtttgtgaattcaaaattttaaaaattaacgttgaacgtcgcaatattgttgtctcaagaagagaactcttagaagctgagagaatctctaagaaagccgaacttattgaacaaatttctatcggagaataccgcaaaggagttgttaaaaacattactgactttggtgtattcttagatctcgatggtattgacggtcttctccacattaccgatatgacctggaagcgcatacgacatccttccgaaatggtcgaattgaatcaagagttggaagtaattattttaagcgtagataaagaaaaaggacgagttgctctaggtctcaaacaaaaagagcataatccttgggaagatattgagaagaaataccctcctggaaaacgagttcttggtaaaattgtgaagcttctcccctacggagctttcattgaaattgaagagggcattgaaggtctaattcacatttctgaaatgtcttgggtgaaaaatattgtagatcctagtgaagtcgtaaataaaggcgatgaagttgaagccattgttctatctattcagaaggacgaaggaaaaatttctctaggattaaagcaaacagaacgtaatccttgggacaatatcgaagaaaaatatcctataggtctccatgtcaatgctgaaatcaagaacttaaccaattacggtgctttcgttgaattagaaccaggaattgagggtctgattcatatttctgacatgagttggattaaaaaagtctctcacccttcagaactattcaaaaaaggaaattctgtagaggctgttattttatcagtagacaaagaaagtaaaaaaattactttaggagttaagcaattaagttctaatccttggaatgaaattgaagctatgttccctgctggcacagtaatttcaggagttgtgactaaaatcactgcatttggagcctttgttgagctacaaaacgggattgaaggattgattcacgtttcagaactttctgacaagccctttgcaaaaattgaagatattatctccattggagaaaatgtttctgcaaaagtaattaagctagatccagatcataaaaaagtttctctttctgtaaaagaatacttagctgacaatgcttatgatcaagactctaggactgaattagatttcaaggattctcaaggccctaaagagagaaagaaaaaaggaaaatagcatctaatgctggtaatgcagaggatcgtattatttagttctaaataatacgtccttaatttagctatttactgatttccttatttacaagaggagtataatgaataaaaatcttgtagctatttttgactacatggagaaagaaaaagggattcagcgctctactattataggagctatcgaatctgctttaaaaattgctgctaaaaaaaccttaagagatgacgcgaacatatctgtaaacattaattctcgtactggtgacatcgaagtcttttgtgaaaaggaaatagtagaaatttgtcagaatcctagcaaagaaattcctttagataaagccagagaatacgatccggactgtcagattggtcagtacatggatgtcccttttgtttctgataattttggaagaatagctgctcacgcagcacgacaaattatcggtcaaaagctaagacatgctgagagagacgttatttatgaagaatatcgccatcgcgtaaatgaaactttatctggtgttgtcaaacgttttgctaaaggttctaatttaattattgacttaggaaaagttgaagcaattcttcctacccggttttatcctaaaacagaaaaacataagatcggtgataaaatttacgccctactctatgaagttcaagagtctgaaaatggtggagcggaagttatcctcagtcgtagtcacgcagaatttgttaaacaattatttattcaagaagtcccagaactagaagaaggttctgtggagattgttaagatagctcgtgaagctgggtaccgcacgaaactagctgtaagatcgtcagaccctaaaactgatcctgttggagcttttgtaggtatgcgaggttctcgagtaaaaaatatcattcgagaattgaacgatgagaaaattgacattgtcaattactcccccgtctctacagagttattacagaatcttctttatccaatagaaatccaaaagattgctattttagaagacgacaaagtgattgcaattgtcgttaatgatgcagactacgctactgttattggtaaacgaggaattaacgctcgtttaattagccacattctagactacgagctcgaagtacaacgtatgagtgagtacaataagttgctagaaattcaacgccttcaattagcagaattcgatagtccgcacttagatcaacccttagaaatggaagggattagtaagctagtcatccaaaatttagaacatgctggatatgacacaattagaagagtattattagcgagtgctaatgatctggcatctgttcctgggatcagtttagagcttgcttataagatccttgagcaagtcagcaaatatggagaaagtaaagttgacgaaaaacctgaaattgaagattaagaatgctcaattaacgaaagccgcggggctggataagctaaaacaaaaacttgcccaagcaggatcttctgaagctaaatcttcttcagaaaaaccttctgcgaaagaaaagtctgtaaaagtagctcttgccgcaacttctacccctacggcaagtgcggaacaagcttcaccagagtctacttcacgtcgcattcgtgctaaaaatcgttcgtcgttctcatcatccgaagaagagtcttctgctcatattccagtggatacatctgaacctgctccagtctccatagcagatcctgagcctgagttagaagtagtcgatgaggtttgtgacgaaagtcctgaggttcatccagttgctgaagttcttcctgagcaacccgtattgcccgaaaccccacctcaagaaaaagaattagagcctaagcctgtgaagcctgctgaacctaaaagcgtcgtaatgattaaatctaagttcggccctacaggaaagcatatcaatcatctcctagcaaaaacattcaaggctcctgccaaggaagagaaagtcgtagctggctcgaaaagcacaaagcccgttgcttcagataaaacagggaaacctggaacatctgaaggtggtgaacagaataatcgagaaaaacaattcaatcctgctaaccgtagtcctgcttctggtccaaaaagagatgctgggaagaaaaatcttaccgactttcgtgatcgttctaagaaatctgatgaaagcctaaaggcttttacaggaagagatcgttacggattaaatgaaggcggagaagaagacagatggcgaaaaaaacgtgtttataagcctaaaaaacactatgacgaagcctctatccagcgacctacgcatatcaaaatttccttgccaattaccgtcaaagatctggcagcagaaatgaagctcaaggcttcagaagtcattcaaaagttattcattcatggaatgacctatgtagtcaatgatattctagacagcgaaactgcagtacaatttattggcttagagtttggatgtacaattgacatcgactattctgagcaagataagttgtgcctaagcaatgacactgtaagagacgaaattcaatctacagatcccagcaagcttgtgattcgctcccctattgttgcgtttatgggtcacgtcgaccacggaaaaacaacactcattgactccttaaggaaaagtaatgtcgctgcaacagaagctggagcgattacccaacacatgggagccttctgctgctccaccccagtgggagacataacaattttagatactcctggtcacgaagctttctctgcaatgcgagcccgtggagctgaagtttgtgatattgttgtgcttgtagtcgctggagacgaaggaattaaagaacaaactttagaggctattgaacatgcaaaagctgctgatatcgctattgttgtagctatcaacaagtgtgataagcctaattttaattccgaaaccatctatagacaactttctgaaatcaatctattgccagaagcttggggaggctcgactgttacagtaaatacctccgcaaaaacaggagaaggtctttcagaacttttagagatgttagctttacaagctgaagtcttggagctaaaagccgatccttcagcacgtgctcgaggacttgttattgaatcagaactgcacaagggtctcggacctgttgcgactgttttgattcaaaatggaagcttaaaactgggcgaagctctcgtcttcaatgattgttatggcaaagtgaaaactatgcataacgaacataatgaattgatgaaagaagctgggccatctattcctgtgttgatcacaggtctatcggacattcctaaagctggcgatcctttcttcgtcgtgaaaaacgagaaaacggctagagacattattgaagctagatccgcaggacaacagcgttttgctttacagcaaaagaagcggcctaactttgattctatgttacagaataaaaagactcttaagcttatgattaaagctgatgttcaaggttccatagaagctttggtcagttcaatatctaagattaaatcagaaaaagtagatgttgaaattttaacaaacagtgtaggagaaatttcagaatcagacattcgtttagctgccgcctctaaagcagttctcatcggtttccatacaggaatagaaagtcatgcggaacctttaattaagagcttaggagtccgagttgaactatttaccgtcatctatcatgctattgatgcaattaaagaaattatgacttctctattagatcctattgctgaagaaaaagatgaaggttctgctgagattaaagaaatctttaggtcttcacaagtaggatctatttacggttgcatagttactgaaggaattatgactcgcaatcataaagtccgagtattacgtaataaagagatcctttggaaaggtacgttatcttcattaaaacgtgttaaagaagatgtcaaagaagttcgcaaaggtttagagtgtggaattttgttagaaggataccagcaagctcaaataggtgatgtcctacaatgttatgaagttatctatcatccacaaaaactataacttgaagtactgtatgacagaaaatagacgtattaaacgggtaaatgctttattacaagaagccattgcaaaggtaattttaaaagatgttaagcatcccaagatttctaatctttggatcacggtaactcgtgtttctctatctaaggatttgcactctgcacgtgtttatgtatctgtaatgcctcatgagaataccaaggaagaggctttagaagctttaaaagtctctgctggttttatcgctcatagagcttcgaaaaatgtcgtccttaaatatttcccagaacttcatttttatctcgatgatattttctcacctcaagattatatagaaaacctgctttggcagattcaagagaaagaaaagagttaataaactatattttttgggaacttgaatactattaaagacatgactatggatcttgcagtagaattaaaagagggcattcttcttgtagacaagcctcaagggagaacttcgtttagccttatccgcgctctaaccaagttaataggcgttaaaaagattggtcatgcaggaactttagatcccttcgctactggcgttatggtcatgttgattggccgtaaatttactagactttctgatattttactttttgaagacaaggaatacgaagcaattgcccatttagggacaactaccgattcttatgattgcgacggcaaagttgtaggaagatctaagaagattcctagtctcgaagaagtattatcagctgccgagtatttccaaggagagatccagcaactgcctcccatgttttccgctaaaaaagtccaagggaaaaagctgtatgaatatgctagaaaaggtttatctatagaacgtcaccattctacagttcaagttcacttgcagattacgaaatatgagtaccctttattgcattttgtagtctcttgtagcaaaggaacttatattcgcagcattgctcatgagcttggcacgatgttaggctgtggagcttatcttgagcagctacgccgtttacgcagtggccgtttttctatagatgaatgtattgatgggaatctattagaccaccccgatttcgatatttctccctacctacgagatgcccatggaaatagcctatagtttaacgtcttcgttttctgtagattctgtaactgtaggttttttcgacggatgtcatctagggcatagcaatcttttatctattcttacttcctattctggatccagtggagttattacctttgattctcatcctcaaacggtactttctttaaatcacacgaaactcatcaatacaaaagaagagcgcctccaattattgcaaacgtttcccatagactggttaggtgtccttacttttgatttaaattttgcgaatcaatcggcagaagaatttcttactttgttacatcgtaacttgaaatgcaaacgcctcatcttaggttatgattcttgcatagggaaagaacagcaaagcaataccgaggctctcgatactataggcaagccgttaggtatagaggtcatcaagattcctccttaccgtatggataacatagttgtctccagcaaagcaatccgccagtttctgtccgcagggaatcttgaatgtgctcatcgttttttgggtcatccctatgccatttctggaaaaataaccgagggctccggaataggaggttctctaggattcgccactataaatcttcctagagaagaaagtttaattcccctaggagtttatgcttgtgaaatacgttatgatagcactacctgtcagggtgttatgaatttaggaactgcccctacttttggaagagagtctttatatgcagaggcgcatatcttttcctttgcggaaaatctatacggcaaagaagtgagcattatcccgagaaaatttcttagagaagaaaaaaagtttcaatcaaaagaaactctaatacgagcaattgaaaaagacattttggatgctcaagattggtttgcaaagggttcctttaattatgaaggaacagcatagtatcaccgtcctggacgatataatcacgtccttctatatgtaatttccctaattctcgagcagctgcacgaccttgacactctatcatatcttcaaaagtaatcacttcagcacgaataaagcccttttgaatatccgtatggatttctccagcagcttcccaagcagaagaccctcgaaccactgtccatgcacgagattcttgaggacctgtagtaaaataagaaatcagtcctaaagtgtcatacgcagcacgcactaatctatgaagtcctgatttttcaagacctaagctcataagaaattctaagcgctcttcaataggtaaggaaacgatttcttcttctatacgaacacagataggaaccactttagaattttcttttgcagcaacttcccgaacagcggcaacataatcattatccatatctggtagagaactctcgtcaacattagctatataaaacataggcttcatggtcaaaaacggatagggctttaatgccacaatttgttctggagttaattctaaagtacgtagcggcagccccttttctaagtgagcaataattgtatcaaatagaggcaagagagctcctacttcacgctttcctttggctagcttttctaatttgctatggatattttttgctgaggagaagtcagaaaaaatgagctctaagttgataacttcaatatcctcaacagggttgacttttcctgaaacgtgtgtaacgtctggatcatcaaaacaacgcactacatgagcaatagcatgagtttctcgaatatgagagagaaaccgatttcccagacccgcgccatcggaagctcccttaactaaacctgcaatatctacaaatttcatatccgcatagatgatcttctgactattgctaattttagctaaggcttccagtctttcatcgataacaggaacaatacccacattaggatcgatagtacaaaacggatagttacaggaggcaacttgagctcctgttaaagcattgaataagccagactttcctacattaggaagccctacaattccacattcagtatgactcataagacatctaaaaataaaaataatgacatgctttttcgaatattagaaagacaactcttctgtttcaaaaaagcacaatagctagaaaaatagtaccttcaaaatcaagagtgctttgaaaatgataaaaaaccactataatcgattgaagttttccctacctaatactttcttcatatagaaccatcttgaagtgacctaaagtattgctaaattcaacaacttttcgttattgttctttttttctactattcttctttatctctaagattcatttataatcttactaagaacaaaacgtttgggcttcactcttgagaaaaacaagagcataaggtaatttgcagataattccgaatatagtcctcttaatcgaaccttggcaacagcatgggtgaaaaaacagaaaaggccacgccgaagcgacttagagatgctcggaaaaaaggtcaagtagcaaaatctcaggattttccttctgcggttacctttatcgtctctatgtttacggctttctccctatcgaccttttttttcaagcatttaggtggctttctggtttccatgctctcacaagctcccactcgccatgatcctgtaattaccttattttatcttaagaactgtcttatgcttattttaacagcatcacttcccttactgggagctgttgctgttgttggcgtcattgtaggttttcttatcgttggtcctacattttctaccgaagtttttaaaccagatatcaagaagttcaaccctattgagaacatcaaacaaaagtttaaaataaagactctcatagagctgatcaaatcgattttaaaaatttttggagcagccttaattttatacataacgttaaaaagcaaagtctctttaattatagaaactgcaggagtctctcctataattactgctcaaatcttcaaagaaattttttataaagcagtaacctcgataggaattttctttttgattgttgcgattcttgaccttgtctatcagcgccacaatttcgctaaagaattaaagatggagaagtttgaggttaagcaggagtttaaagacacggaaggaaatcctgagattaaaggccgtcgtcgacaaattgctcaagaaattgcctatgaagactcgtcatcacaggtgaaacatgcaagcaccgtagtctctaatcccaaagatattgctgttgctattggctacatgcctgaaaaatataaagcaccttggatcattgccatgggcatcaacttacgagctaaaaggatacttgatgaagctgaaaagtacggaattcccattatgcgaaacgtacctttagcacatcagcttttggatgaagggaaggaattaaaatttattccagaatctacttacgaagctattggagaaattctactctatatcacttcactgaatgcgcaaaatcctaataataaaaatactaaccaacctgatcatttataatgaataagctactcaatttcgtcagcagaacacttggtggcgataccgccttaaacatgatcaataagtccagcgacttaatccttgctctttggatgatgggcgttgtcttaatgatcattattcctttgcctccgcctatcgttgacttgatgatcaccatcaacttatcgatctctgtattcttattgatggtggctctttatattccaagtgctttgcagctgtctgtttttccctcgttgctcctcatcactacgatgttccgcttggggattaatatttcctcttctcgacagattctccttaaagcgtatgcgggtcatgtcattcaggccttcggagacttcgtggttggagggaactatgtggtcgggttcattatcttcctcattattacaatcattcagtttatcgtagtaactaagggtgccgagcgtgttgccgaagttgctgcccgattccgattggatgcgatgccaggtaaacagatggcgattgatgcggacttacgagctggtatgattgatgccacacaagctcgtgataaaagggctcaaatccaaaaggaaagtgaactctacggagccatggacggtgccatgaagttcatcaaaggagacgttatcgctggtatcgttatctctttgattaacattgttggcggtttgacgattggggtggctatgcacggcatggacctcgctcaagcagctcacgtctacactcttctctccattggagatggtttagtctctcaaattccttctcttttgattgcgttgacagcgggtattgtcacgactcgtgtatcgagtgacaaaaatacgaacttgggtaaagagatttctactcagctcgttaaagaaccacgagcactactccttgcaggtgctgcaactttaggggttggtttcttcaagggcttccctctatggtccttctccattttagcattaattttcgttgccttagggattctcctactgactaagaaatcagcggcaggaaaaaaaggtggtggctcaggagcttcaacaaccgtaggggctgctggtgatggcgctgctactgttggggataatcccgatgactattctctaactcttcccgtaattctagaacttggaaaagatctctctaagcttatccaacacaagacaaaatcaggacaaagctttgttgatgatatgattcctaaaatgcggcaagctctctatcaggatatcggaatccgataccctggcattcatgttcgcacagattccccttctttagaaggatacgattatatgattctgcttaatgaagtcccttatgtgcgaggaaaaattcctccgcaccatgtgttaaccaatgaggtggaggacaatctcagccgttataatctacctttcattacctataagaatgctgcgggtcttccttcagcttgggttagtgaagatgcaaaagctattctagagaaggcagcaattaaatattggacgccgctcgaagtgatcattctccatctttcgtactttttccataaaagctctcaagagtttttgggaattcaagaggtacgttctatgatcgaatttatggaacgttcattcccggacttagtgaaggaagtcacaaggcttattccattgcaaaagcttacggaaatctttaagagattggttcaagagcaaatctcaattaaagacctacgtacaatcttagaatctctgagcgagtgggcgcaaactgagaaagatacagttttgcttacagaatatgtacggtcttctttaaagctttatatcagcttcaagttctctcaaggacaatcagcaatttctgtttatctcttagatccagaaattgaagagatgattcgtggagcaattaaacagacatcggcaggttcttaccttgctctagatcctgattctgtgaacctaattttaaaatctatgaggaatacgatcacgccaacacctgcaggaggccaaccaccagtattattgacagcaattgatgtaagaagatatgtacgaaaattaatagaaacagaattccctgacattgctgtgatttcttatcaagaaatcctaccagaaatccgcatccagcctttaggaagaattcagattttctaattgatacgttgtcgctcataggaggcatatggcagcatcaggaggcacaggtggtttaggaggcactcagggtgtcaaccttgcagctgtagaagctgcagctgcaaaagcagatgcagcagaagttgtagccagccaagaaggttctgagatgaacatgattcaacaatctcaggacctgacaaatcccgcagcagcaacacgcacgaaaaaaaaggaagagaagtttcaaactctagaatctcggaaaaaaggagaagctggaaaggctgagaaaaaatctgaatctacagaagagaagcctgacacagatcttgctgataagtatgcttctgggaattctgaaatctctggtcaagaacttcgcggcctgcgtgatgcaataggagacgatgcttctccagaagacattcttgctcttgtacaagagaaaattaaagacccagctctgcaatccacagctttggactacctggttcaaacgactccaccctcccaaggtaaattaaaagaagcgcttatccaagcaaggaatactcatacggagcaattcggacgaactgctattggtgcgaaaaacatcttatttgcctctcaagaatatgcagaccaactgaatgtttctccttcagggcttcgctctttgtacttagaagtgactggagacacacatacctgtgatcagctactttctatgcttcaagaccgctatacctaccaagatatggctattgtcagctcctttctaatgaaaggaatggcaacagaattaaaaaggcagggtccctacgtacccagtgcgcaactacaagttctcatgacagaaactcgtaacctgcaagcagttcttacctcgtacgattactttgaaagtcgcgttcctattttactcgatagcttaaaagctgagggaatccaaactccttctgatctaaactttgtgaaggtagctgagtcctaccataaaatcattaacgataagttcccaacagcatctaaagtagaacgagaagtccgcaatctcataggagacgatgttgattctgtgaccggtgtcttgaacttattcttttctgctttacgtcaaacgtcgtcacgccttttctcttcagcagacaaacgtcagcaattaggagctatgattgctaatgctttagatgctgtaaatataaacaatgaagattatcccaaagcatcagacttccctaaaccctatccttggtcatgattaaaaaaggattgccatgcaaaaccaatacgagcaattactagaatccttagcacccctattaaatacgacacttgctccagataaaaataactcttgtttaatccgtttcagcgatacccatgtccctgtgcaaatagaagaagatggaaattccggagatcttgcagtatcgacactactaggtactcttcctgaaaacgtatttcgcgagcgtattttcaaagctgctctctctgtaaatggctcgttccaatccagcatcaagggaattctaggctacggtgaggtcactcaacagctctatctttcagatatcctgagtatgaactacctaaatggagaaaagttattcgagtatctcaagctcttttctttgcatgctaagatttggatggaatccctaagaacagggaatcttcctgaccttcatgttttgggaatctactacgtcgcgtgaatgttttaaaatacacaaaacactcaccctcagcacatgcttggaaacttataggaacctctcctaaacacgggatttatctcccactattttcaatacacacaaaaaatagctgtggaatcggtgaatttttagatctcattcctctgatctcttggtgccaaaaacagggcttcagcgttattcagcttctccctttaaatgatactggtgaagatacgagtccctataacagcatctcttccgtagccctgaatcccctattcctttccctatcctctcttccaaatatcgataccatccctgaagttgccaagaaacttcaagatatgcatgagttatgctcgactccatcagtcagctatactcaagttaaagaaaaaaaatgggcattcttaagagagtactaccaaaaatgttgcaagtcttccctcgaaggaaactcaaatttttctgagtttctagaaagcgagcgctattggctttatccctatgggacctttcgtgcaatcaaacatcatatgcacggagaacctattaataactggccgaagtcgctcacagatcaggagaattttccggacttaactaaaaaattccatgatgaagtcctctttttttcctatctacagtttctctgttaccaacagctctgcgaagtgaaagcctatgcagatcaacaccacgtcctgcttaaaggagacctccctattcttattagcaaggatagctgtgatgtttggtatttccgagactacttttcttcatcaaggtctgtaggagctcctcctgacctctacaattctgaaggacaaaactggcatctgcctatttataatttttcacaacttgccaaagacgactacatttggtggaaagagcgtctgcgatatgctcaaaacttctattccgtctatcgcttagatcatattataggatttttccgtttgtggatttgggattcttcaggaagaggaaggttcattccagacaatcctaaagactatataaagcagggcacggagatcctttctactatgctcggagcctcttctatgttacctatcggagaagatttagggattataccccaagacgtcaaaacgacattaacacacttaggaatctgtggaacccggattccacgatgggaacgcaactgggaaagcgacagtgccttcattcccctaaaagattataatccactttctgtgaccactctctctacccacgactctgatacgtttgcccaatggtggctcaattcacctaaggaagctaagcaatttgctaaatttctacatcttccttttcaaaaaaccctgactacagaaactcaaatagacatcttaaaactttctcatgaatcagcatctatctttcatatcaacctctttaacgattatctcgccctctgccctgatttagtatcaaaaaatctacaaagagaacgcattaatacacctgggacaatttctaaaaagaattggtcgtatcgagttcggccttccttagaagaactcgctattcataaaaaatttaatggttacattgagaagatccttacaggactgtaaggatagcaataaaacatttaagtctttttatagtaagaaccttataataatttcctggaacgaccgtctttcttaaaagaattccttcattatcaacaacagacaatcacattttctaagaaaacctcttccccatatattcgaaaagctctagtatagattccttttcatagagttgctttattgagcggatgttagagaattcataggaagaatatgtcaagaaagtgcccacttacaggaaagagacctcgccgtggttatagctatacacttcgaggtattgctaaaaagaaaaaaggaattggtttgaaagtgacagggaagactaaaagaagatttttccctaatatgttgaccaagcgtctatggtctacagaagaaaaccgttttcttaagcttaaaatttctgctagcgctcttcgtcacattgataagctcggattagagaaagttctcgaaagagctaaaagtaaaaatttttaatttaacttaagtatagggaaatatttatgtctttcttaaggcgtcatatttctctttttcgttcacaaaaacaacttattgatgtttttgctcccgtaagtcctaacctcgagttagctgagattcatcgtcgtgttattgaagatcaaggccctgcccttctttttcataatgtcatcggatcgtcattcccagtcctgaccaatctctttggaacaaaacatcgtgtagaccaacttttttctcaagctcctgataacctcatcgctcgagttgcccaccttatttcttctacaccaaagctttcttctctatggaaatctcgggatctattaaaaagaataagctctttagggctcaaaaaagctcgattccgtcgctttccttttgtttctatgtcctcagttaacttagatcaccttcccttactcacaagctggcctgaagatggtggagcctttctcacacttcctcttgtctatacggaatcgccgactcttactacacccaatcttgggatgtatcgcgtgcaacggttcaatcaaaacaccatgggcctccattttcaaatccagaagggcggagggatgcatctgtatgaagcagagcaaaaaaagcaaaaccttcctgtttcggtatttttgtctggaaacccctttttaaccctttctgcgattgcccccctacctgagaatgtctcggaacttctctttgctaccttcctccaaggagcgaagctcctttataaaaaaacaaacgaccatccccaccctctactctacgatgcggaattcatcctggtcggagaatctccggccgggaaacgtcgtcctgaaggtccttttggcgatcatttcggatactacagtctccaacatgacttccctgaattccactgtcataaaatctatcacagaaaagatgcaatctatcctgctacagtagtcggcaaaccctaccaagaagatttttatatagggaacaaactccaagaatacctctcccctttatttccgttagttatgcctggtgtgcgtagacttaaaagttacggagaatcagggtttcatgcactgactgcggctgtcgttaaagaacgctattggagagaatctctaaccacagctcttagaattcttggagagggccaactttccctaacgaaattcctaatggtcacagaccaagaggtgcctctcgacaggttctccgtggttctagaaaccattttagagcgtctacagccagaccgagatcttattattttctcagaaactgcaaacgatacgttagactatacaggaccaagcttaaataagggctccaagggaatcttcatgggaataggaaaagccatccgagaccttccccatggatatcagggaggaaaaatccatggagttcaagacatcgctcccttttgtcgtggttgcctagtgttggaaacatccctcgaggaccgatgtattaaatctctccttcaccatccagatctaaaatcatggcctctgattatccttgccgataatctgagagaaaccattcaaagtgaaaaagattttctctggaggaccttcacacgatgtgccccagcaaatgatcttcacgcgctccacagccattttgctactcaccgtcctaattacaactttcccttcgttatcgatgccctgatgaagccttcctatcctaaagaagtagaggtcgacccatctacaaaacaaaaggtttccgaacgatggcacgcatatttccccaataaagaaactttttatatttaataagaatcttattctattaaacgtttaattaaattagttatttttatttttaaaaatatataaaaacaaaaaagctattttaagagtaaaaaatgaataaaagacaaaaagataaattaaaaatctgtgttattattagcacgttgattttagtaggaatttttgcaagagctcctcgtggtgacacttttaagacttttttaaagtctgaagaagctatcatctactcaaatcaatgcaatgaggacatgcgtaaaattctatgcgatgctatagaacacgctgatgaagagatcttcctacgtatttataacctctcagaacccaagatccaacagagtttaactcgacaagctcaagcaaaaaacaaagttacgatctactatcaaaaatttaaaattccccaaatcttaaagcaagccagcaatgtaactttagtcgagcaacctccagcagggcgtaaactgatgcatcaaaaagctctttccatagataagaaagatgcttggctaggatctgcgaactacaccaatctttctctacgtttagataataatctcattctaggaatgcatagctcggagctctgtgatctcattatcacaaatacctctggagacttttctataaaggatcaaacaggaaagtattttgttcttcctcaagatcgtaaaattgcaatacaagctgtactcgaaaaaatccagacagctcagaaaaccatccaagttgctatgtttgctctgacccactcggagattattcaagccttacatcaagcaaaacaacgaggaatccatgtagatattatcattgatagaagtcatagcaaacttacttttaagcaattacgacaattaaatatcaataaagactttgtttctataaataccgcaccctgtactcttcaccataagtttgcagttatagataataaaactctacttgcaggatctataaattggtctaaaggaagattctccttaaatgatgaaagcttgatcatactggaaaacctgaccaaacaacaaaatcagaaacttcgaatgatttggaaagatctagctaagcattcagaacatcctacagtagacgatgaagaaaaagaaattatagaaaaaagtcttccagtagaagagcaagaagcagcgtgatgatctaaaatagtcacagaagaaggcctagctcgtgattcaagtatgtctaggcctcttcatccttttgataaaaaagagtggaggcagtttctaagactcctttatttctagcaattacccaagcttctgctgctgctgcaattgcctgagaagcggcagcccctaaagagatgcccttttttttctttgtaactttaatagatcgcttctgtttgtttttttcgtctttttcctgatcttcttttttcttactatcgcaatatagttttttaaaatctaaatgcacatgacgcaactgagaaagcaagaccttggcttgcttttgtccgagtagcttataacgatgcctctgtttcttctcctcttgttcgcgatctccaatagctagcaaggcaagccgaatcgcttcattcgtagcaatttcctcagaaattttttctactaaaggagagttttgacgggaatctttagctatgctttgtgcagatagcgcaccataaggatcaaaacgaattatacgcatcacatcaaaccgacttaaaaccctaaatatccgtagataatttttttcccttcttttcctgacgggaagctttctggcccgaagatcctcttctttgatctccgctaaaaccaccactatttccccccccaccatcgtcatgaactgaagcagcttcaggctttccttgaaccgatagacgtgaagatcctgaaaacggctggggagaacggagaacaattggcggctcaacagcaacatttcgatactgataaatcaaaggatctggaggacctccaggacctttatgagcttcgagcttctctttatagtcatcagtagcacgaggtagaggagcgagtaaagacactccacgttgcgcaaggaaatgatatgaggaactcacagcatcacttcctaaagcccctcccgtaccactttccttagggaaaacactctccacagcaatagggagaaagttttgactgctattctctggatttttgaatgccgtagattctttaacaacggcttcaggttcctccctggaaacgatgctatctttaggaaaacgatacatactttctggatgaggcaaacttttaacctcagcactcttcacagtaccttcccgaagaggagaaaagttcgtatggttcgtactcttctctattcctggagatttatgctttgatttatctcccgatctctgggtgggtaaagttcctgaaaacttgggaggaggaaatactgtagaaggaccagaccaaacagaattactcaatacctcttgaggcgctgcccctgtaagaagcccagccatagcacgtgcaagcatcatctgatcctcactcaactgctctcgactttcttgtttctctgcttccttttccgccctttctaaagtattagaatttggaattcctgttggattcgcttctggagaatcagaagaagatacctttacttttccttctactgctctgggagatgtcatggctgtactgacctcttcctgtcctaaatcagaaagatctatcatgccttcgttgcctgttgccattgccctgcgcactaatgatgaggtctcaacattgggatcgagaagagagctgaccatctcccctcctaaacgagccactgtccaagcatttaccttctcctcactcataggctctatggccttttggaaagatccaaacgaagccacggaactagattctgaagagcttaaacttaaactcctggcacctgaaaatgctgaagatttcaaagcctctaaagaaagctgagaaatatcagaggaactccctcccatacccgaagcatctaagaaaaatccctgcatttcaggtgaaatacggtttcccttctttagagcaacatccatctctgtcggcaataaggatgttccctcaccactatcggaagcacgctttgctgacactctcgaagcccgagatccgaatcctgacatgaatccttgcacactagcgcgcattttagaaaatgtacctttcaatttggattttggagaggttgatgatcgatcttgagctttacgatacttagccttatttatctgagattctgttgcatacattcctgtagatcctgaacgcactaagctttcctgcttcgcagcagaggaggcctgcttggtttcagaaaatatagattcttttagcggagacgggccttctgcctgctctccttgcagagcaggattccactttcctggatccgaagaaggctgaacccctccgccacctgaaactgccataatgattctctgaatttaaaaaataaaacttataactacttataattttaaaacaaaaaataattaatttaaaaaaaagaacttacaaacaaattttaaaaatctaaaaaacaaaaaaaaacgcaaggtgaaacaccttgcgtaaaaaaacttatgggaggacagagaacagcgagtagatgcaacaaagtgcatcgctgtcgagctagagggatcactcggatccgactgtctaggtattaagattttggagatcttaataccgagacagttcctaactctaaattaattacccaggcttcctgtcgttccatcacgggatagtcccgttctgcgatttttttttaatttaaccccgcctaaagacggatagagtacttactaaaatggtccttgtcagtaaaaacaaacccattctcataattgaaaatcaaaactttatcggtgtccttcttctgagaatctaagagagagcgaactaactgatcgtattcttgagcacggtgtttaagagttttctgttccttagcaataagaaatttacgacgatttttagcttttatccgcgcaggcttcttcaacacttccgttgatttcttttgaatctcctgagccaaagccctatccgttctgctcttcttaggcttccccataaaaaatacaaaaacaaaaaaatcaacttaataaactaattttaattaaaaaacttattaagaataaactaattttaatctaaaaataaaatattatataaataattgtttaaaagcagtttagataaacataaaaaatcaagctaagaatcctatgctttgctatatacaagtctgcaaaaccttttgaaatcgataatcataattcaaagcgtaaaccatgtctgtccacataacaccgcgcaaatgctttattttgtgtattttatccatgttcacccttccaacgctcttccctaaagcacatctgatccttttttccccttatattgttctttgtttctattgtttctcaaaagataagggactggtactcgctctaggctgtggtgtcttaagtgatcttgccttaggaagccgcggtgtatttctactgctctaccctctaactgctctgatcacccataaggcacacctcattttttcaaaagagagcaaagccgccttggtcattgtgaatatgattttctatggagtctttttactcctaaccattcctatgtgcgccttgttcggacatgaagtccgttggtcaatagatgtgctaatgatacctctaaaatgttctttcttagataatctcatcttcacttctgtaatctatatacttccttgcgcaataaactcaggaatccataaaatgatatctttttttaggagattggtatgttactgagagggattcctgcagctgaaaaaatccttcagagactcaaagaggaaatctcacaaagtcctacctctccggggcttgctgtggtcctgattggcaatgaccccgcatctgaggtgtacgttggcatgaaagtcaaaaaagctacagaaatcggaattatctccaaagcgcacaagttaccctctgactctaccctctcctcagtccttaagctcatagaacgattgaatcaagatcctagcatccacggcatcctcgtgcaacttcccttgcccaaacacttggacagcgaagtgattctccaagcgatctccccagacaaagatgtggacgggcttcaccctgtgaacatgggaaagttgctccttggaaattttgatggacttctaccctgcactcctgcaggaattattgaactcctgaactattatgaaattcctcttcgaggccgccatgccgctattgtagggagaagcaacatcgtggggaaacccttagcggccctcatgatgcaaaagcatcctcaaactaactgtacagtcacagttcttcatagccagtcggaaaacctcccagaaatcttaaagacagctgatatcattattgctgctctaggagcaccgctttttataaaggaaactatggtagccccacatgctgtgatcgtagatgtaggaacaacaagagtccctgcagacaatgcgaaaggctatactcttcttggggatgtagattttaataacgttgtgacaaaatgcgcagcaatcactccagttcctggaggcgttggtcccatgactgtcgctatgctcatgagcaatacatggcgatgttaccaaaatttttcttagttcttttatgtcttggactctgttcatgctctcaaaaaacgacaacaatcgaaggagagcagatgacaatcttctatcgcattgttctgggaacctctttatccgcaaaagaaaaagcatctttatcccaacaaattgatagatgctttcataagatcgactcgatttataacaactggaatccctattctgaactctcgataatcaaccgagctccagcagatgtccccataactttatctgtagaactttccgagtttctagatcaggtagatacactttacaaactttcagaaggacgttttgaccctactgtaggacctttaaaaaccctatggcttctacatctcaaaagtcaaaccctcccccctaaagacgtttgggaacaacattataaagacatgggctggcaacacttggagtttcagtcaaacacaaaaactctaatcaaaaagaatcctcatgttcaaatcgacctctgtggtgttgtcaaaggttatgccgtagattgtctaaatgaaatttgcaataccttttgtccgaacaactatgtagagtggggaggagagatcaaaacgtcagggcatcatccctcgggaagaccttggcgtattttttctgaagcagcaggtacgatcttagatatcgatgatatggcaattgcaacaagtggaaatcatattcaaaaatggtgtgttgaaggaaaaatttacacccatattcttgatactcgtacagggaaacccctagagctaagctcctatcctatccaaagtgtttcagtagtccatccgagctgcgcatacgccgacgctattgccacagtcctcatgacttttgattctaaaatagaagcaaaacagtgggctgaagaacaccatatcctaacctatatcaatgatggcgcctcttcatagcagcggcaacttcacgttccttttctctttctatgatcgtacgacgcttatcataagcttttttcccacgacaacaacccaaacgtaccttaacatagccgcgactcagaaacattcccagaggaatcaaagtcatgcccttttgagcaatcttaccctctaacttacgaagttcatatctatgaagaaggagtttacgtttacgacgctcctcatggttatagatatttccaaaccgatagggagcaatactcgcgtttaataaccacccctcacctttagaaacaatgacataagcatcaccgaggtttcccccatgatcgcgcaacgacttaatctcagtcccagtcaaaacgatgcctgcttctaaagtctctataacttcatagttacgcagagccttgcgattagaaacaatttctttttgtgccataagatcctcccccataattggggacaaaaaccagtataacaaaaagcaatttttccttcttaagacaatgattagaatcctctttccttgatttccagggaagatttcctcaatctaaagccttttttattagtaaaatatctagaagaccagaaaatcactttgtagtaatatcccgatcgtacctctaccgtctctcctagagaggcgtagcccttcatataaagttagactcaggttataggaaaatatgaaattcgttgtatcccgaaatgagctaggaaaccttatcaaaaaaattcaaagtgtcgtccctcaaaacacacctattccagtactcacccatgttttgattgaaacttataatgatgaattagttttcactgctacggatctgacagtgagcacacgttgcgtcaccaaagctaaagtctatgagaaaggcgctatttccattccctccaagagattttttcaattagtaaaagaattaacagaggcaaatttagaaatttcctcttcagcaggggaaatggcacaaatcacctcgggatcttcatgctttcgcctactcagcatggaaaaagaagacttccccatgctccctgatatacaaaatgctttgcgtttttccttgcctgcagagcagctaaaaaccatgctacagagaacttcattcgctgtatctagagaagaaagccgctatgttcttactggagtcctgcttgctatcgccaatggcgtggctaccatcgtagggactgacggaaagcgtttagcaaaaatagatgctgaagttactttagataaaagtttttctggggaatatattattcctatcaaagcagtagaagaaattataaagatgtgctccgatgaaggtgaagctgcgatcttcttggatcaagataagattgcggttgaatgtgacaatactctcctgatcacaaaacttctttctggagaatttccagatttctcccccgtcatatctacagaaagcaacgtaaaactcgatctgcatcgcgaagaactaattactctgctcaaacaagtggctttatttacaaatgagtcctctcactccgtgaagttttctttcttacccggagagctcactctaacagccaactgtactaaggtgggtgaaggaaaggtaagcatggctgtaaattattctggcgaactcctagaaattgcctttaatccctttttctttttagatatcctgaagcatagtaaggatgaattagtcagcttagggatctcggattcctataatcctggaatcattaccgattctgcctcaggattatttgtcatcatgcctatgaggctacatgatgattaataaactccctaaggagaatcctttaggtcactaccctgccgatgtttatgaaaatctgctctctgaagctaaaaaattttcgtaaccacagtgatttagaaatctcactggctcctaaactcaattatgcccaaggaaaaacaaacctcctagaagcgctttatgttttgtccttgggaaggtcttttcgcacgcaacatctcacagataccatcaccttcggatcttcccatttcttcttagaaacacagtttgagaaagaccaccttccccaagctctctccatctatacagacaagcaaggaaaaaaaatctgctataaccaacttcctataaaaaccttatcgcagctgatagggaaagtacctattgtgcttttctcttcaaaagaccgccttctaatttcaggagctcctgcggatcgtcgccttttcctaaatctgcttttatctcaatgcgataaccactataccctctgcttatcgtactatcatcgcgctcttcagcagagaaatgctctcttaaaaagcaagcaaacctcaaccgtggcctctgggatgaacagttggtcaaacacggcacctacctatccatccaacggtttctctgtagtcagaaactttcagatttatccaaagaactttggtctaacaacctaaaagaacaattggccttaaaatttaaaagttccttaattaaaaattctgatatttctgaaactgctgttgccgaagaatttcataaacagctctctatatcacttcctagagatctcgaatgaggaagcacttccgttggccctcatcgcgaagactttctactcactatgaaccaaatgcctgtgtctcaattctctagtgaagggcagaaacacagtcttttggcaatcttaaggcttgctgagtgcctatatctaaagcaatctcatcacgtctcccctctagtctgtctagatgatatccatgctggattagataatgaacgtgtcggtcaactccttgaccctgccccaactctgggtcagactctgattacttccacccatatgcatggggaacttccaaaaacaagccttgttttaagtatcgagaacgctcaagtttctgagcaaattatctaaaacaataacatcatttttcttttgcgttaaaagtaagcgaattagttatttttataaataagttttaataaacatattcttttttaataaaaaacttatttaaaataattatatcggtgacacatgaagaaatttttattaactatactctttttagctgtgggtaatcctttattctcggaaacctcggtaatccaaacccttccatctggaattgggggattaaaggaaacctcaaaacaaaaagaatccgtggtctgcgtgcatgcgtttttaagatcttatacatctttaaaacctattgctcgcgttctagaaaaagaacattacgatgtctttatttggaattatgagacgcgcaagtttactctagaaaagcatgctgaacatctcaatcgcttgctgaaaaaaatagctgaacttaagcctggagtccctataaacttcgtaactcattctattggaggagtcattgttcgtgtagcactcgctcaccctgattgccccgaagaagccaaaaaagaaaagctattctcatggctcctccgaacgcagggtctacactagctagacgctaccgctgtgtgaaattcgtacagttcgtatttggaggaaaattaggacgacagcttcttacctactgccccacaaagatgttaaatgtcgggaaactcccttcgtctttagacgttctcattcttagtgggaacagacatagcaaattccttcctttccgcctgccctatgaaaacgatggtaaggtatgcactatagagacaaagctagatactccacataaagcttacgtgatccacacgagtcatacctacatcattactaatcggaagtcgctctatcttatgaaagagtttttaaaagaaggaaatacaaccccgataatcgagcacgttcccgaagcagctttagaacaaactgttatggaagacaaacaaaagaactcaagacttaagccttaccctaaccaagacatctacgttatacactgctttggttctcgtccttacaacctttacggatttccaaaaaaatggagccttaaccaaaaaaacgaaataaatcctgaaaagttagaaaaataaagaagatgatcaataaaaaagtgaacggaaccaaaatcctttccacaatcttcatattcaaacgtcttcttttgactatctcccacaaacatagaaggatataacctccatccaaaacaggaataggaagcaaattcaagacagccaaattcatactaattagaccgatccaaaagagcacttcagaaaaccctaccgaccatcctgtatgtaaaacctgcacaatacccacaggtcctgaaagccattgtggactcagatgtccagtaactaaagctttcaaggtgatcaaactttccttagtaatatttgataacataaccacaggtgaaggattatacctcaccttaagatctttcaaagaaatccctaaagatggtttttgcttctcagcatcaagacgctccaaatagtatctttgtttatccttgttcttaatcttcttagctacttccaactgtttatccaaactctccgaagaataaacatcaatccaaggacgaggctgaacagggtcaagaagacgataaggacccgcgacttctactgggtgagactctcctaaatggttcaaaatttgtaacagatcttcggaatgataagaggcgataaaccgcttatcagcatctcgagaattcacctcttcaagttcttgcggactcatctgctgaacaataatagagacccgatggttctgaacaagacgtaaaatatctacacttccagaaacaggagttccatcaatagctagaatgcgatccccaagctgtagcctctcttgaggttgtggcaaaggagactctggatctatagcagtaagttcaccttctatgtatccataactattgattacataaggcaatgtatataacgaagaccacttgcctttaagtccagcctcatactgcgtatctataagctcattacgaaggtagggagtgtaatgtaaaacggaagccaataccctaggttgacgagaaaagaagattttgtcattccgtgctactttcacaaaagcataagactcattgagtatctgagatatctgagccattgagaaaagaagtgtgccatccatccaaacgaaacgatcattcggacgtagctctgaattctccataggagagttcttcgttaggggcacctggttgctatacaaaagataactcgctccagaacagggaaccccgaattttgtgggatcaaactcaacatcaatagcgaactctttgctaggaactgtcaaatagccaggacgtttgatttctagattgagatgcccctctaataaagaggttgttagcatgtccttatctcccacataaggcttaccattacacgtaagaatctcgtctccagggagcaatccttctgcctgtaaaacaggatggacccaacctaccactttagaacagtcgctataatttttacttcttcccccattcatgtaaagaatgctgaaagccaagacagctaataaaatattggcaagaggaccagcaacaagaaccagaatgcgtttccaaggagacttactaaaaaatccctgaggaatatcatagacagagtctatcttccccttctcccctttttctttggtacgttccatacctctgatacgaacatagcctccaaaaggaatgcatccaatgcgatattctatgccgcctatacgctttttaaataaagcaggaccaaagcctatgctaaaactctctacagccattcctacagcttttgctactaccagatgaccaagttcatgaattaacactaaaatccctaaagctagggctgctagaataaaatagattattgtcatatacctactcgattatatttcttgagcaagagctctagcctcaccatctacttctaaaatatcttctaaagagtggcaggcataaaccttatgacattccataagagtcgttaatttgcgtaaaatgtcacaccaagaaatctcttcgcaaaggaacctccgcactaatacttcattggctgcattaaaaaagcttccagaagacccctgtttctctaatacctgttgtgctaaacggatactaggaaatcgctcctcatctaccggaaaaaattctaaagtttgtttcttcgaaaaatccataccatccctaggagatgcaaaacgctctggagctgttaaagcgtattgtattgggaagagcatatcaggcggattcatgatagaaatcacactcccatctaaaaactctaccataccatggattaagctctgaggatgaattacagccaggatttcaacattttctaaaccaaacagccaatacgcctcgataatttcgagtcccttattgaccaatgtggatgagtccacagtcacttttgaacccatattccatataggatggttcaaaacatcttgttttgttacacaagaaagctcttctaaagacttgttgagcagaggccctccagaagctgtaagaatcagtttcttgattccctcaatcgtcctgccttctaaacattgatacaaagcattatgctcgctatcaataggaagaacttttataccattttcctttgcagtcttagaaaccaattcgccagcacaaactaaaatttctttgtttgctaaagctagtgcttttccttttttcatcgactctagaatcgcgggtagcgcctcgattcctgaagaagcagcaacgacagtagtgactgtatccatgatacaaagttgggttaaaccctcctggcctaggaaaaattgcatatgggggaatcgctgacaggcctcgttataaacctcttcgttatagaccgctgcggctaacggagcaaactcctctagttgctgaaaaaataaccttagattatttccataagaagccatagaaataattttaaattctgaaggatagcgccgcacaatctctaatgtttgacggccaatactacctgttgacccaagaacggctaaatgtttcaagcatgctacctttaactaggtgaaaaagagaatcatactccgcaagtcgaggaattgtcaattctctattgatactatttctaactaaagtggactaaactctaaaatttcattcttttaaatcactgctaatattgagaacttttctcacttattttttcaaaatttttagaaaaatagcctcgaaaatagcttataaatttaaccacgatgtacatcatcgtcaagaacactacagagattcccgaagtcgataaccccaaatcataagcactaagaattgctctcgaagatgcaggagctaaaaatgctgtaccaatactaaaaactaacgaccaagccataagactccttatcgattttgcaataaccttagcaataagcgatggaatgatcagaaaagcaagtgccattaatacacctacagccttaaaagctcctacaagacatgcagaaagttgaaaaataatcaaataatcaaccaaccgaataggaattcctaaagaagaggcaaatacagaatcgaaagaagaacaaactaagctacggaacgcaaaaatagtaattacagcattagccaaaatcacaatagtgacagggaaaatatcctctttcgttaaagaatctgcgtttcctaacacaagctccgttcctatatgagcattctttgtcataaagactaacaaaacaaggctcagagagaataataaagaaaagactagagcggtgctgctctcttctgaaactttaaaagtattacgaataaagtaaataagaaaccctgtcagcatagctgttgccattgctgcaagagtcaaggtacccaaagagagggtcgtcagttgatgcgtaaacaaacaaacacagaccaaaccaaaaaggacagtatgagagacagcattcgcatacatagccatctttcgcaagactaaaaaagttcctgcaaaagcacctgaacaggaaatagcaaggaatactataatctgaatatcatcaatatagagagaacccgtgaaaagacttccagaaaacagtctcgaaaaaaatactgaaaaaaattggaaaaaagatactccataataaggagaaggtcccaaagccattagacttccttttttttatttgggataatttgtcgatgaggatcataacaaggatcattgagaatctctgtcaaggtatgatccaattcttcagtaagaacatgctctatttcctcagccaactcatgaacactttccttgctaaaatctaaagaattcacaagatacgattcccataatctgtgagcacgaactaatcttaaggcctcacttcttcctttttttgtgagtcgataataatcttgttcttttttaacataaccccgccattctaaaatctgaactctccatctagggaaaggcttaggcccaaaatactcctgatacttataactacagacaaaatctcgaacactaatgttctctaaacgattatgagaaatatgccaaaacacctttaaaaggtgttcttgatcctttgaaaacgaaaagtgcttcctacggacaaaacgaatgacccacccagattttggagaaaaaagcaaacatagaccggccaataatccagcacaaatgacaaccaaaggtcccgtaggcaaggttacaggcaccgcctgttgccctataatagcacgacatgtgaatgctacagagatatagcttcctaaagctccgctaatccctccaaagaatgcagaaaggataagaattgtacttagacgatcggaaagctgacgagcacctaaagaaggagccacaaacatagcagaaattaaaacaatccctacgcttcgaactccacttacgatcaccaacgatataaaaattagactgagtgcttcataaagaacagtctttaagccacaagtaacagcaaaatctttatcaaaagtagtcacaacaatttgtcgataccaccaccataaagcaaataacgaagcacaaaagacgatcgcagccaacgtagcttcaagaaaacctaaagtggctgcttgcccatatagataggcgttaatgcgattgtatagcgtagggctactttccttgacataactggctaaaatcactccgatagcaaagaataccacaagaacaaaacaaagggcggagtctttatgtaatttacatactttccctaagaaaacaatgatcccataaccaaataccgaagcagcacacccaaacaacacaatccaaaaaatagaagcttgcaatgagaaaacatattgcgccatcaaagctccaactagaagtcctggatacgacgcgtgagataaactttcgcttaaaagaggctgcttgctaatcaagagaattgtcccccacaaagctgtggtcatacaaatcaaagtgacagctaaaaaactagataagaaaatcgtatcagaaaaaacacaactgagcataatcagcacgatccaaattgttttcctcgagagagcttcagggtttgttccaaaagttcaatttcacaaccatacgtttggaaaatagtgtctccattcagacattcatcagtagggccacaacaaatcaaacgcttattcaataaaaccacatgatcaaatagttgacgcacatgactcaagtcatgatgaacaacgacgatagtctttccctgatctcgcagctcttgcaaaacccctacagatgttttaaacgaagccatatcaatcgctgaaaacaactcatccataagatatagatctgctttttgcatcaaagcacgtgctaaaaatgctctttgttgctgtcctcctgagagctgtcctatttgtctatctgctacggattccaaaccaactctttctaaaatatgaaaggcctcccttcgatcatccgaagaaattctcccccacattcctttatagctgtaacaccccataagggctaaatctaagacagtcattggaaaatcccaatccacgctagctctctgaggcatataggctatgcgctgacgcaccttcttaaatttttgattaaaaaaataaacagtccccgaagagggtttgatcaggcctaaggaagcctttaagagagtgcttttaccagctccattaggacctaaaatagcagttaatgacccctttcccaaggaaaaggatatgtgataaagaacggctgcatgctcatagtttacacaaaggttgtgtacagaccaaaaagtctcatctttgacattcaagagccacccctcctaattcttctgtgataaggcagacattatgtttaaaggtgctaaaataattgtcgtccacattatcactatacaatggtttttgagctagacgaactaaatgacttttcttcagagaagaaacaatttttttcaacgcatcttggttcagagtatcctcagggaaaaccacactgacatcatgctcattaatataatctacaaccgccataatatcacgaacactgatttgagcttctggagatagaccctcaggagaaatacaacgagacctccatgctccggaagccacttcttcaggagtagctaaatagcgacgtgtaaagtaactgaacgcattatgacctgagacaagataccgtaaattttcaggaattgtgctcaagcattgtttcgcccaagaatctaaaatagacatttcacaaacaagttcctcactatttgctttaaattcagcagaccattcagggaacttttcaatgagaacttctgtaatttctatgacagcttccttccaaatagaaagatccatccagatatgaggatcgcaaataccgtcttcttctagaggaacaaaggccccacgcgctatcaaccgctcccctaacttgacactattgggattattttctaaatgcttccgcaaacttaatgtatgctcaagacccaggccgttacaaaaaattacggcacttccagcaatcttgtccttatcccctttaaccatctcatacgcatgagggtctaaggatcctttgatcaaaacagcggtagcaagcctattccccacgactctttcaacacaatcatgaatcatgcgattcatggatagtatacaaggacgtgaatttgcattctgaaacccagaattggtacatccaaaagttataccacatgccacgaaacagaaaatccaacgcatcactttaaatatatatcccattttcgcatccatctctctagaagcattttttaagatccattaaaaaccacttaaagtaccagaaaaacaagttctattcaaaatatattttatccagcaagaaatacaactaatagaaatgaaagaaatatctttgttcaggatagttttaaaaaaattagaaaacccgtttgttttataagaaaacaaaatgttatagaaaaaatcttctttactttacgatttttatgttttgaattttgttaagaaacaaaaagatcctgagaggaaaaatattgcaaaaaggagaacttgcaatataatttatgttcgctgattgattaaaacagcgctttaattttatttctctaaacattaaattgaaagtatgccacattctttcttgtaaaatatgtaagcatcaattataaaaggtgggtttcatggccgtagaacaatcacatataaaagaagaaatagaaaaactgatcggaaaagctattaaaagagtctgcggaaacaaagaaaacgatttatgtcgctatcttccaggccctagcggcggttatatgcatcatttcactctaaaaaagatgaaaagcgctgctcccgaacaacttttaaaaatgttaaaaacatttattttagaatcggaaaccccacgcacaattaatcctaagcctagagctcctagaggctctaaaaaacgtcgtgactttattaactttactaaaacagatattgaacgcgttttagaactggcaagacaagttggagacaaagacctcctcgctcgctttagccctaaaaaaccgttaacttctttaaaaagggagttaattcgttcgattcgcaacggtatcgtgagcgtagagctatggaatgcctacgtcgaagctgtgaaggctgtaagctctcccaaccttgaagttacctctcctttcgtttaattaaaaaataaattttacaggcgacttagcaataaagtcgcctaagaactcttatcccttaggagtatccctttcctcttgtcaatagagagaaaagatggtatattataaggtctttcgaaatggaaacaattcaagttagtccacaacgaaataaaaaactatcagaatagaaaataaaagtatttcagagggtaaatatgacaaaaaccgaagaaaaaccttttggaaaattgcgctctttcttgtggccgatacatactcacgagctaaagaaagttctgccaatgttcctaatgttcttctgtattacatttaactatacggtgttacgcgatacaaaagacactcttattgtgggagctcctggttctggtgcagaggcaatacctttcatcaagttttggcttgttgtcccctgtgctattatctttatgcttatttatgcaaagctaagtaatattttaagtaagcaggccttattttatgcagtgggaacgccctttttaattttctttgccctgttcccgactgtaatttatccgctacgcgatgttttacatcctacagaatttgctgaccgtttacaggccatcctacctccaggattgctaggactcgttgccatcttaagaaactggacatttgctgcattttatgtacttgctgaactatggggaagcgtcatgctatctctaatgttctggggatttgctaatgaaattacaaaaatccacgaagcaaagcgtttctacgctcttttcggtatcggagctaatatttctttactagcttctggtcgtgcaattgtttgggcttcaaagttgagagcttccgtttctgaaggtgtagatccttggggaatttctttacgtcttttgatggctatgactattgtatctggacttgttcttatggccagttactggtggatcaataagaacgtattgaccgatcctcgcttctataatccagaagaaatgcaaaaggggaaaaaaggtgctaaacctaaaatgaatatgaaagatagcttcctctatcttgctagatctccttatattcttttattagctctcttggttattgcctatggtatttgcattaacttaatcgaagtgacttggaaaagtcagctgaaactgcaatatcctaatatgaatgactatagtgagttcatggggaacttctccttctggactggcgtagtatccgtacttatcatgctatttgttggtggtaacgtcattcgtaaatttggatggttaactggagccctagtcactcctgtcatggttctcctaacaggtatcgttttcttcgctcttgttatctttagaaaccaagcttctgggctggtcgctatgttcggtacaactcctctcatgctagctgtggttgtcggagctatacagaatattctttcgaaatccacaaaatacgctctctttgactcaactaaagaaatggcctatatccctcttgaccaagagcaaaaagtcaaaggtaaggctgctattgatgtagttgctgcccgcttcggaaaatcaggaggagctttaatccaacaaggtttgctcgttatctgtggaagtattggagctatgaccccttatcttgcagtgattcttcttttcatcattgctatttggttggtttctgcaactaagttaaacaaactattcttagcgcagtctgctcttaaagaacaagaagtggctcaagaagattcagctcctgcttcttcatagagttgcttctcttactcttgttgatccctacctgctttttagtgggtagggattttttttattaactcccatttcacgaattcgtacgcttttttcaatcaaaaggttataataaccgtgagacattctggttgtactatgaagtgtagtcctttaacactagttccccatatatttttaaaaaatgactgcgaatgtcatagatcttgttctttaaaaattaggacaattgcccgactcattcttgggcttgttctagctcttgttagcgcactttcttttgttttccttgctgcgccgattagctatgctattggaggaactttagctttagccgctatcgtaatcttgattataacgctagtcgtagcactgctagctaaatcaaaggttctgcccatccccaacgaacttcagaagattatttacaatcgctatcctaaagaagtcttttatttcgtgaaaacacactccctgactgttaacgaattaaaaatatttattaattgctggaaaagcggtacagacctgcctccgaatttacataaaaaagcagaggctttcgggatcgatattctaaaatctatagatttaaccctgtttccagagttcgaagagattcttcttcaaaactgcccgttatactggctctcccattttatagacaaaactgaatctgttgctggggaaatcggattaaataaaacacaaaaagtttatggtttacttgggcccttagcgtttcataaaggatatacaactattttccactcttatacacgccctctactaacattaatctcagaatcacagtataagttcctatatagtaaagcgtctaagaatcaatgggattctccttctgtgaaaaaaacctgcgaagaaatattcaaggaactcccccacaatatgattttccggaaggatgttcaaggaatctcacaattcttatttcttttcttttctcatggtatcacttgggaacaggctcagatgattcaacttataaatcctgataattggaaaatgttgtgtcagtttgataaagcaggaggccactgttccatggcaacatttggaggctttttgaatactgaaacaaatatgttcgatccagtatcctctaactatgaacctacagtgaacttcatgacgtggaaagaattgaaggttttactagagaaagtaaaagaaagtcctatgcacccagcgagtgctcttgttcagaagatatgcgtaaatacaacgcaccatcaaaatctgttaaaacgatggcaatttgttcgtaatacgagttcacaatggacatcaagcttacctcagtatgctttccacgcccaaacctacaaactagagaaaaaaatagaaagcagtctccctatacgatcttccctataaggggagtctgatcatttgcaatacctacaagcaaattgcgtttgaaagactttttataattgagatttagaaatataaaaaaatctttaatttttataaaaagaatacgttattcccaatcgggaaaagaacaaaaaggggctcgccctttttttaaaaaaagcataacaagctctctcgttattcttcttctagaagctatcttcaatgaaaacttttcatcaataatacaaaacaatttcaataaaaattttaaaaataaaaacatttctattaataggatttttgttaaatttacgatataatacgcaaattgatgagcctaggaaatgtatgagtaatataacctcgccagttattcaaaataatcgctcttgtaattattattttgaattaaagaattcaaccactattcatattgttatcagtgccatcttactctgcggagctttgatagctttcttgtgtgtagcagctcctgtttcctatattctaagtggcgcattgttaggattaggattattaatagccttgattggtgtgattttaggaataaaaaaaatcacgcctatgatttcatcaaaagaacaagtattcccccaagaactcgtaaatagaatcagggcgcactatcctaaatttgtctctgattttgtttcagaagctaaaccaaatcttaaagatctcataagttttattgatcttctaaatcaattgcactctgaagttggatcatctacaaattacaacgtatctgaagaactacaacagaaaatagatacgttcgagggtatcgcacgcttaaaaaatgaagtccgtactgcttctcttaaaagacttgaaagcgctgcttcttcccgtcccctcttcccctctttaccaaaaatcttacaaaaggtatttccatttttctggttaggagagtttatttctgcaggcagcaaggttgtagagctccatcgagttaagaaaattggaggcagcctcgaagaagaccttagtgattatataaaaccagagatgcttcctacctattggttgattcctttagattttagaccaacaaattcctctattctaaatctacacacattagttttagctagagtcttaactcgtgatgtttttcaacatcttaagtatgcagcattaaatggcgagtggaacctgaatcatagtgatctaaatactatgaaacagcagctctttgctaaatatcatgcggcgtatcaatcctataaacatctatctcaaccctctcttcaagaggatgaattctataacctgctcttgtgtatttttaagcataggtactcgtggaagcagatgtccttaataaaaacagtcccggctgatttatgggaaaacctctgttgcttgactttagaccatacaggacgaccccaagacatggaatttgcctctctaattggtactctctacacacaaggcctaattcataaagaaagcgaagcatttctttcttcattgacactccttagtttagatcagtttaaaacgatccgtcgtcagtcaaccaatatagcgatgttccttgagaatttagcaactcataattccacctttagaagcttaccacctataacagtccatccactcaagagaagcgtcttctcccaacctgaagaagacgagtcctccctgctgataggttagagatttctattttggaataagaaaaattctactccctctcgtagcccctttcgagactaaaaagctagttacctggtttagtctttaaagaagatactcgtcttcctatgaattctagctcctgttacaaaattgacgtcataaaccctagctctggcatttccatgctctagagctattctgtgaagaccctgtcttaatacactctctaatcgcttagaaactgaactcaaatgccttaacaagaatttacctagttctttctttggctcatcagaagcagaaaatgcttgaacagcttcttttagatcctgaatcacatacaggcctaggtttacatcaaaatcgatagaagattcgtcaagaagattttgggatgacaaagctcctacaagagcacaaagctgaaggttgtatgcggtactgttatctacaaaacacagccaatcccaagcatctctaggaagttgagtgatcagctgtagctgatcaaaagaatagccatgcaagctcaacaatagcaattccttactgattgtctcttttgtaagtccccctgcttcggtctttagagttcctcgtgccgtataggtagtgtagatacgctctacaattgctttgacttcatcagtatcccatttctcttgaagagccttgttttttaataaaagaacgtcctctttcgttaattgttgaagaatatgatgcgtctctttacaaaaaattgtagccttagctgtactgtatcccaaaggccctagccaatagtacccataacattctctagggacacctaggtctctacaaacttgtggatctcctgctgatataaatttctgaagccaatataacgggcaggtttggcttaaaagatcttcaaatattggccaattattcttttctaaatcacctgcgagcctgctaataccaaaactctctactttacttcgcaattcagaaggcaattgtttgattttctcttcaggagatatgttacacaacagggcagtagaaaattgtctaaactcggctaatgttacctgctgttctcttacaaatgcagagattgaaaggccataagcttcatctatcacgtgagtaaatctatcaggaatgattcttggtgttggtggaagcttcttctctccaaaaatcaaagctaaaattactaaagaaagaatgacaaaggcaataaaagctaaaacactcccaacaatataagaaacgggaggagccaaacagcctaaagctgctaatgcacctatacaaaagaggctggcaatggctattcttacaatagtccttgaactcaaaggaaaggtagaatgacactcgcaatgatttttaaataaagcatgtggaacgatcgtcatgctcatagccaactccttagatatagatctattgaaggcagtatagattatgtgtaaataaaaatctctaattcaagaatttcctgtaataaaaaatcccatgaaaaatagctctctcttacccttcagattaggcaaactttttacaatccccgaaaaaaatgcagatcgaacacttaaggatttcaaaaatttctgccaagctgacctaggatttttttctcactccctatctaaatggtatttaggataattcaagaaggtattttcgaacctttgatttagatctaaggaacctaggtactgtctaaacctttgaaagtgtttttcaaatacattacaaagatcttttgcaaccccgtgttttgttggtttgcttaataactgcatttctatcagttcttcccaggtcaatagagaaacctcaggaaggtaaaattgctcttttgcttcgtataatgcccaggacgaatgtaacagcccaaccagacgtgataactggaatccctcgccttgagaatcaaaatcacaaagccaatcccatccggactcattcatatattgaaataattgcacttgctttcaagagagcttgtgagaaaaaataaggtgaaggagggaatcaaactgttcgtaatcagcgtttaactctgcttcatctacctcttctttatcagcataatatcttgtaaaaaggttttgtctgatttgaacgagttccgaagaactccacgtgtttttcttgagaccatcttctaaaagagcaaactctccaaagctaattttctttaacaatagaagagatcgacgttcaaaaagagagggagcgttctcgtacagtcctaaaggaccacaccaatagtatccataggttcctggagtgacatccgataccatgggatataccagacgtcccaaccaatgcaatgggcaatgctgtagaagaatttcttcaaaattagggagcttacttggatgtacatctttgaacttctcaatgccaaactgtaagagtttttcttgtaaatatactggtgctttgtcgaaaacattcgtcttattaagaatagagatcaagtgatgtatctcataaatggaaacctcctgatctctaataaaatcaacaacaatacttggataatgttcttggatgagttccatgattttcttagggatcagcaactccttaggttcttgtctcatcttataaatcataaacatagcagaagcaaaaagaataagagaaactagaacaagagcagttcctaactctatggataaaagagattgactgcataccaaagctacaatagcgagtacagcagcaacaacagaaacgataatcaggctaagcgctggctggcacaccgaaaattgggtagcctgactatagttgacttgggtattcctatacacaggctgtatattaaccatagaagctccattgtgacttgagtatcagcgtgttatattattttcctaatcattttagaattcatggaattattttacttctataaatttctttcacatagactccagagcttgaaaaaatcgattgcgaagacctgaactcctactcaaatagatctcctgactttccagttcttcactacattgaagagcactatctcggacataagaacactcattcctctcttatactcttggatcgagtcgatttaactatctcaaaccccaatgctttcatgaattttattatgcttgtctaaatgactgaaaaaatgacccgcaaggactttagatgaacatatgtaaatggtaaatatttttttatctcttttagaatcggtttccctttctatagaatcctgagtgggaatcagtttcatactaacggagagcacttcttctcacttagttttttctactgctagccactctggaactctacctcaaatcagattcgactttaaacccttgtggtttctacatctcatctattatactttcatctatccaaagctaaagatgaccgcatgatcattttgctaataaagagatgcagtccgcaaaagtatttgagaagctggtctttgtctgaaggagccttctcaatgcagctttatgaaaccaggaataaacctagataacactacagtacattttgaaagaatataagatagagaacattcgcaatttttcaatcatagcgcatattgatcacgggaagtctacaattgctgatcgccttttagaaagtacgagcacagtagaagaacgggagatgcgtgagcagctcttagattccatggatcttgaaagagagcgtggcattacaattaaagctcatcctgtcaccatgacgtatctatatgaaggagaggtgtatcaactgaacctgattgatacccctggtcacgtggacttttcgtatgaagtctctcgatctctatctgcatgtgagggcgccttacttattgtagatgccgcccagggggtgcaggcacaaagtcttgctaatgtctacctggcccttgaaagagatttagagatcattcctgtattaaacaagattgatctacctgccgctgatcccgtgagaattgctcaacagattgaagattatataggcctagacactacgaacattattgcctgttctgcaaaaacaggtcaggggatccctgcaatcctgaaagcaattatcgatcttgttcctcctccaaaagcacctgcagaaacagagcttaaagctttagtctttgattctcattatgacccttacgttggcattatggtctacgtacgcattattagcggggaattaaaaaaaggagaccgcattacttttatggcggctaaaggctcctcgtttgaagtcttaggtataggggcctttctccctaaagcaacatttatagaaggttccttacgccctggtcaggtgggtttttttattgccaatctcaaaaaagtgaaggatgtgaagatcggcgatacagtcacgaaaacaaaacatcctgcaaaaactcctttggaaggcttcaaagagatcaatccggtagtttttgctggaatttatcctatagattcttctgattttgatactttgaaagatgctttaggaagactacagctcaatgattctgctttaactatagaacaagaaagcagtcactctttaggctttggttttcgttgtggcttcttaggacttcttcatcttgagattatctttgaaagaatcattcgagaatttgacttagatattattgcaacggctccaagtgtcatctataaagtcgtcttaaaaaacgggaaagttctagatattgataacccctcaggatatccggatcctgcgatcatcgagcatgtggaagagccttgggttcatgtgaatattatcacccctcaagaatatctgagcaacattatgaacctctgtttagataaacgtgggatctgcgtaaaaacagaaatgctagatcagcaccgtctagttcttgcttacgaactccctttaaatgagattgtctcggatttcaatgacaagctgaagtcagtaactaaaggttatggatcctttgactaccgtcttggggattaccgtaagggatcgatcatcaaattagaggttcttattaacgaggagcccatagatgctttttcttgtttagtccatagagataaagcagaatctcgtggaagaagtatctgcgaaaagcttgtggacgtgattccacaacaactcttcaagattcccatccaagctgccattaacaaaaaagtcattgccagagaaacgattcgtgcgctttctaagaacgtgaccgcaaagtgttatggcggagatattactaggaaacgcaagctgtgggaaaagcaaaagaaaggaaaaaaacgtatgaaggaatttggaaaagtttccattcccaatacagctttcattgaagttctaaaattagattaacattgacgcttaaaatcagcacactgcttacaattgaaaattcggtagtggtgaactaaatctcgagctacctagggtcttctcgagattttttatttttacttcactctttctgtagttttcgtgtgcacccaatcggtatgatagaactctcctcgagggcgatcgttacgctcgtaggtatgagctccaaaataatctcgcagtccttgagctaacgacattgaagagcttgctgtacgatagccatcataaaacgtgattgctgctgctaaacagggaataggtagccctgcaccaattgcagtcactactgttctacgccatcccatctccgcatggcgtaatgctccacggaaatattcttggaagatgagcgaggtattctctgggttggcagcaaatcctttatgtataacatctaaaaatgcactttgaataatgcatcccccgcgccacatcaaagcaatttctcctaggtctaatccccaattatattcttttgaagcttctcctaaaagcatgaatccctgagcatagctgatgatcttggaagcgtataaagcatgaaagacatcttgtatgaataccgagggatcatggggcatttcaaatattaagggggttcctggataattacgggcagcttgctcgcgtatctctttccaagaagaaaggaaacgagcaagaacagctcctatgattaaggaaaggggaactccagaatttaaagcatcgattgcggtccactttcctgtacctttttggcccacgacatctaaaatcgtatcaataacagggattccttccggatctttcaatgctaggacttcagaagcaatacgaattagatagctttccaactctagagtattccactctttcaaaattgtagcaacggcagttgcggagagctttaggaaatctcttaagataccgtaagcttcgcatatcaactggatatcgccgtattctataccattgtgaacagcctttacatagtggcctgcaccgccagttcctacccaagaacagcagggacggccctgtacttttgctgctattgattgaaaaataggagccactaatggccacgcctcaggatttcctccaggcataattgatgggccgtgacgtgcaccttcttctcctccagaaatccccacgcctaagaagagaatccccttttcttgcaactctttacatcgtcgttcggaatctttaaaatagctattccccccatcgataatcacatcgccgggttctagaaaaggcagtaacgcatgaatgctctgatccacaggtttccctgcttgaatcatcaacatgatctttcgtggtctctccaatgaattcacaaaatcttctaaagattcaaaccctacaagctctcggtggttagggtattctttcaagaagtcccgcgttttctctggggtccgattatagacagagacagaaaaaccatgatctatcatgtttaagacaagatttttccccatgacagctaagccaataagaccaatattcgtttgcaaagctacctagcctccttaaactaatttaaatatagaacaagctttcgttttttaccttgagccaacaacacatagtgaccataacagatgtcttgttcttcacaaacactatgctcattagcgatgggcacattattaatatatacccctttttgttcaattagccttcgaatttcccctttagatttacatagtcccaaaacaagaaataggtctaaccaacgtttccctaacacctcggatttatccaatgaggcccccatccctcctgcaaacaattcatgaaaatctttttccgataaggatgaaagattccctggatgcatgctacgagttacagaaagagcctcttcaagccctagatctccatgaatagcacttaagatatcttgggctacaaattccttcactgcaactggatccgtctgtacacgcctatcaatatcttgaatttcttcattgctcaataaagttaacgtacgagcaattttagggatggtatcatcgggcaaacggagtaagtattggtacagctcaaaaggagaggttaaatctgaatcgagccatacagttcccgactctgttttccctatttttttcccctgagcattcgttaataaaggataggtaaggccgtaggcctgacccaaccctttacggcgaataaaatcgattcctgaagtaatattcccccactgatcgctaccaccgcactgcaagatcgtgccataatttttaaataagtgataaaaatcataggattgcaggattaaatagctaaactcggtatagctaattccttcatcagaatgcacccgctgctttattgtatctttcactagcatttggcctaaacgaaagtgttttcctatatcccctaagaaatcaatcagggagatctcctgcaaccagtctgcattatttacaagagtcaccccgggaagatagcgctggagacacgccgtgatcttttgactgttatcaaaaacttcacttgtctgaagtaacgatctctcgctctgtttccctgagggatctccaaccatacctgtggctcccccgactaaagctatgggggtaatccccagagcagcgagtctcttcaagaaacaaatcccaatccaatgaccaatatgtagagcaggtgcggtaggatcaaatcctaaataagcggcgataggtccctctacggattccaaacctgcggtaaaattctctaaaatatttcgctcttgtaaagattgtaaccaggattgcatgagtgatcgtacataattaagaattgccaagctctatcttatcgatcctaaagcttatatgcaaggcaccacctatctaacaataaagaaaagattgtacgctgagaataattcctttgctgagataccataacttctatcttctctaaagattaggtcgctatgtctacatctccaattggggttccgtcgatgctaaacgccgcaactagtctaaatgccacaactagcaaggcaccccttcctacctctaccctagccgaacgtattaaagaatggctgccccgcattcttctcttgattgtaggagcaatcttcacaattgctggctgcattgttatggcgttgactaaacaaattctttacggattactctgtgtcgtaggagggcttctcctagctctaggactgctcttaaaacctgagaactgtatttatcgaaatgcagagagtgctgcgcgaagcttaagcaatgctttagagtgaatttgagagacgcgagactcacttaccccaaggaccttaccgatttccttaaggacaagttcttcatagtagtacagggccatgaccttgcgttccttttcctcaagttcctgaatcgcattggctaaacataaagaaaattcttgtttatctacaacatcgtaccctgtctcggcacgttcatcggggattctctcttcaagagccattccggctccttcatcactttgtgaaggccactcttcattcagagacacgattaatgcaggacgggcagatacaaaccatcccgaaagctcttgttgcgaaatattgagatactcacacagttcaagatccgtgggttccttgcctaaagactggcgaagagaatccatagctcctgacaatttattcgctttttgatggacactacgaggaacccagtcttgcttacgcagatcatcaataatggcagccttaatcagaaataccgcataaccttcaaaacgacgacttctctcaggattataacgttccaccgcacggacgagaccttcaacacccgaagcatacaaatcctcggtctttacatgggaaggcatccctgaaatcaaacgatgaaccacactttttactaaaggcaaatagaactcaattaagctatcgcgatactctatttcctgagtctcccagtagaagttccaaacctctatgatgttttgagtttgctgtgttttcacaaatttttttttatctagttatttattagattaattcaaaaaaaatttttaaacaatatttacaccaacaaaaaaaatacgaaagtaatagtgcttacagaagattaaattaaattaaggaactaaaacctcatctgaaacgatccctaagaaggaaatagggatttctttaggaagctcatcatgagataaaaccaaaagatcagggaaatgtgggtcgagcatttttttcatctcaaatcgtgtttcacagctcgtaactatggctcgaaaatctttaaataccgaccgttctaaaagactgtctactcgacggatcacattctcttgcattacaggattagactttgagtatgagctgtttatcaattcttcaacatgaaaatctatggtaattacctcaagggtttgtttctgatcccagagacttctcccaatccaatatccgagagactttcgcactttttccgcaaggatctccaagctgtctccagaattttggtataccgcaacggcctctagaatctttgggaaaagcttaagcgataccctttctctaacaaggaggcgagaaagaactacaagagagcttaaagagattttcttaggaacgatgtcttcaacagcgatgccaaacactctctctgattcctcaaggtacttttgaactacctcggcattgagagcctcatgagcgatgtttctaaggaaaggaagcacagcctctggagtcatttcatctaagtatacattctggccaaatactcggagccaaggacgctcttcaatacgtagagaagtaagcacaggcaatctaactcctaaatcttcaaatacttcttcggatgctgcacgatatacttgatagaactgtgattcttgttccttagggcaggccccctcaacataagagaacgcacgttctatacaagaatcttctgatgcaggctcttcttttcgatacgccaaccataaaagactcgcgagcaaaacgatagggaattttggagaactgggaatgcagcacaaagaaaagatcaataacgacaccaccctgaaatgctgacgcaactgtttgtagtattcgaacaggtaatttaaaaggctctcttccttatcgattttactaataagagtggctgcagcacacgaagtaagtaaagcaggtacttgactcactaaagcatctcctaaaactgtaaaccacatctgctcaagagcataacccgaagtataataaagacaagttacagaaactacgttcacgagtaaaaggatacaactaataattgcatcccctttaacaaaacgaaagaccccctccatggcagagaagaaatccccttcttctataagggcatttttttgttttttgacagccttataagaagctcttccagaaacaagatcagaatctaaagccatctgttttgctggaagagcctctaagaaaaaccgcgaacggacctctgcgattctttccgaaccctttgaaaccatcaaaaagttcacaaagaaaagaaggaggcacgcaaacgttgctgcccatagacttcctaaagagaagaaactgcctaaagaaacaatcagagaagaggcggttcctgaagagacaatccatcgtgttgatgcaagattcaatcccaaccgcaataggcaaagatataagaaaaatggaggaaaaagcttcgctgaattgcttgaatttaaggtaaagacccaacagaccgttagtaaagacaatgcaaaactaatacacaatccaaaatcaagaaggatctgaggaagaggtaaaaagattagtactaggatgctaagagggacaaagatcattccccttacaccatctttcttcccagacacaaaaacagcctcctagagaatccctgccttttctcatacttccctcttccatatatctgcaagtaaaactctaaagagacgttatgaagcatctttgatcttgtcgactatttccttctatgctaacgttgatctcttttactcgaaaattttattttacggagtatagcgcagcttggttagcgcggttgctttgggagcaataggtcgggggttcgaatccctctactccgaacttcattttaatctatccgacaatacgtagaaggaaaactccatggccaagctagtcattacctctgatgatgaacaacaagagttcgagttagaagacaatagtgagatcgcagagccttgtgaatccatgggcattccctttgcttgtacagaaggtgtctgtggaacttgtgtgatagaggtcttagaaggacgtgagaatctttctgagtttacggaaccagaatacgattttctaggagaacccgaagactctaacgaacgtcttgcttgtcagtgccgcatcaaaggtggctgtgtcaaagttactttctaatcttagaaaataaaaattttatattaatacaacttctattctgacgaactcttttctaagtagttatgcgactctttgcattcaggaaaggcttgatttactcgcgagcctttcccctatctttcttgttttcaaaaaaaatttaactaaataaacttattattttttatatttacttagaaagatgacaaattaaaaaatatttttaaatgcagaaatgtttttaattatttaaatatcaataaaagagatataatttaaaggaactcaggtgaattccttaattatggctacaatctcacccatatctttaactgtagatcatcccctagtagacactaaaaaaaaatcctgcagcaactttgataagattcagtctcgaattctattgattactgcaatctttgctgtcttagttactatagggaccctacttattggtttgcttttaaatattcctgttatctatttcctcacaggaatttcatttattgctgttgttcttagcaactttatcctttataaacgagcaaccaccctcttaaaaccgcgtgcttgtggcaaacacaaagaaataaaaccaaaaagggtctccaccaacctacagtattcttctatctctatcgcaatcaatcgttctaaagaaaactgggaacaccaacccaaggacctacagaatctccccgcaccctctgcattactcacagataacccttacgagatatggaaagctaaacattcactgttttccctagtatccctcctaccgggaggcaatccagaacatctcttaatttcagcttccgaaaatttaggaaagactctgttaattgaagaaacctcgcaaaatgcgcctatatcctcctacgtagataccactccctccccaaaatccttgctcaatgaggcaattcaggaaaccagggtagaaataaatacagaactccctgcgggagattcaggagaacgtttatactggcaacccgatttccgaggccgcgtcttcctcccacaaataccaacaactcctgaagccatctaccaatactactatgcactctatgtcacttatatccagactgcgatcaatacgaacacccaaattatccaaatccctttatacagcttgagggagcatctctattctagagaattgcccccgcaatcaagaatgcaacaatctttggctatgattacagcagtaaaatacatggccgagctgcacccagaatatccgctaactattgcttgtgttgaaagatccttagcccaactacctcaagaaagtattgaggatctctcttaggatctctatctcactcaaaacggctatcctaaaatcaagggtacagtagattcgcgaacgaaaaaacaaactcttggtacgcatcttttcagtttggttatctcgagatgatgagggacaaaaaggctcctaaagcctccaagatctttccatgacgcaattcaagaaaaatcaaaatagcccctcaataatagaaaaaacactctcacgacttatacaaatcaaatacgtaatattttacgcacgaattcttaggtactcttgttttaataaaagatattgcaacacttctcttctaagttaaattaaaaactcatgtttttataaaaaaatattacacaaaagaaaatatagaattttattctctaataaaaattaaattaaggtataatatctgcgcaaattttaattaaaggatattaaaataaatgggatatcttccagtatctgctacggacgttctttttgaaagtccagccgctcccttaatcaatagcgcaaacacacaaaatcagaaactcatagaactcaaggggaagcagcaagctgagtcttctccacggacaatcacttctgtcatattggaagttctcctagtgatcggatgctgcctcatagttcttagtttattggcaatccgccctgctctgcaattcactctagaaactggacatccagctgccattgcagtccttgctgtctcaggaacaattctattggtggctgttatcatcttgttttgctttctagcagctgtgccattcgctgctaagaaaacttataaatatgttaagacggttgatgactatgcttcttggcattctcatcagcaaacaccgaccctaggcactatcttttcaggtatcgtctatgcagaatcccaggcgcaattatagctctcctaaccttacaaactttcttattgagacctctacaactcacccagtttgtgattgacctcctttttgtttaagatagagattatgaagacccaaaaagcggcaattcttataagtctgactgtaccgacttatagacaaaagataagccactgcctgtgtcttcaaattaaaactcattaaattgttattaaatgaaaatatttcacaaatagttaatttctacactgttgtaaaacatcgttctccctaccccccccttttattgacctctgaagatgatatatgggccttcgaaagtaaacctgatgtcctccgttacccatgcccatgaaatacacatgtcttcaccccccattagaatctcaagtagtattgtcgatctaagaagtctttgaatcccatggctggggtagaatcgttccccataaaaccacaaacgccacccttttgaaccaagtggagaaaaaactctgtgtggcacccacttagagttctcttatgaactaaacaataaggtgcgcctgctacgccttaactcattaaaattaatgaaattaaaaagaatttataaaaatctttattatcaaagaaaaagattttttgtaaaaaacaacaaattaagatataatcttttcctttaaatagatattttatgactaaaaccacttcaatcccagatgtacacgagaatcaatcacatttgtctgtagatgagagattgatctcagaatcacccgtgcttactaagaaagaagtgattgctaaaataataaaactcacagctcttattcttgctttagccatagctgtagggactgcagttgttgctggagttcttggtatgcctctcatggctatagccactggtgctgctctccttgcagcagtcgtactctcttgtcttcttttaagaagaagagagccatccaaaccgacagaagagctccttgggccccaaaaacatgtccccaaggatattgcagctcaagtgcaaccctcagtccctctggattaccaaaagctgctgagaaatgaatggaccctagtcaatactctctcagaaatcaatatatcctggactctccaagatcctaatcaaagatactatgtctgggaacatcaaggagccccaattaccttagtagccactacaggagacatcgctaaaccacgcctgaaaacctcaggaagagtcatgattgttaacgcagcgaattcgaacatgcaatctggtggagccggaaccaatgctgctctctcagcagccacacaccctacttgttggaacaatacgagaacatctgggggaaaaataaacactggcaaaggattatctgtgggtgaatgccgctcagcaccctggatcaatagagactggacgaataaatgatacgaacccaggagaagcacatttcttagcacaacttcttggtcctaaatatgaaggagaattgaaagcacatcctgagaaattaagcaatgttattaagaaagcctatttgaactgttttgatgaagctctcaataaccaagccactgtggtccaagtgcctctgatctcttcctctatatactcacctggaggaaagctggaactagaacccgtaaaccaaacaaagcctaatagcagtgcatataagctttaccacatccgtacgtagtgggtaaatgatataaagaaaggtcttatggaagctcttcgctcctttgctgcgcagcacccctcaactcccatgactataatccttacagaccacaaacagctacttatggtcccttttaactaaaaagatctatttcaataggatgcattaataaactaattttgttttataaaaaaatctaataaaaatacaaattagtaatataatagttgaaaattgatctattaataaaatattatgacagattctaatcccctaccctcttatacagacgccagtctctacagaactcctgcgaaacattcctatccgattagactccctctcaaccgtacagatagaatcgagaaaatactgaaaattgtcaccctcacactagccctagcgtgcgctttgggctttagcattgctgctggcattttggctatgcctattttttctgccgtagttgtcataacattagcaattgctgcggtctcactttactcccttttaaagaaacctaaattatacgagattcttcctcaaatcgaacccgaatctgagcaaagttctctgtctccctctccccagcctcctgagcaacaggacctccctttgcagatcgatccacttcccgatcccgaatcactccccgaagtctctcttgctgatctaaccacacccccagaagaacttaccgctatcacggtcactcctggctatgaggctcttcttgaacaaaactgggatcttcttccgagcttagccgctgtagacccatcgtttactacagaaacacctcagcagccctgttttatttggaagcttaaagactcgaagcttatctttatatctacctcaggagatattgcagttccaagaatcaaaactcaaggcagggtgatgattgttaacgcagcaaacgagaacatctcccgagaaggagggggaacgaataaagctctatccctggctacaagtctacagtgttggaacgcatctaggctccctagagcgcactctcgttctggatcccaactacagccaggagaatgccgctcagcaaaatgggaaaatagtgatcacacctcaaacgaccatgtcccaggcaaagcacacttcttagcacaactgcttggtcccgaagctgctaagtgtaacaacgatcctaagcaagcatttgaagtaagcaagaaagcgtttcataacctgttccaagaagctgaaatcataggcgttgatgtgattcaactccccctcattggatgtaatctatttgctccatcaagacttctaaacctcgggaaaacaagagcagaatggatcgaggctataaaattggcactcatcacatctcttcaagattttggatgggaacaagacaaccaggaagagcaaaaaattatcatccttacagacaaggaccagcctcccatcattccaccccgtttcgatctaacgactccctagtctatgtcggaaagcgtccgtgcttccaatcgaacagctttctaaaaacacagccaatttatcctgatcacaagcaccccctagattcttggctctaagccgcatccaatactttttaaagtgaaaatgttgtctatttattattttaaataaacaacttctatttaaaatataaataacttcacataaaaaagaatcttttttaaactttttgttttttatttaaaaagttttatgtccaccacagaacccaatttgactaacgtaaatctaaccatgctgatcagcagcgaaagcatgcccacgcaactcgcatctcataagctcaaaggtctggaccttgtcgcttttattctaattataggaattgctgtaagttctggaaccgctgctataattttaggcattcctctattatttattcttaccgctctagcagtcttggcttttagtattcttctctattttctcttaagagaacctaaaagtcctataagcgtaacgcatcagccgacgcccatcataaaagatacagaccttcctcctgtcccgcccctagcactcaccccagtgcctacggaagctgtcctagaagagcccccgcttccttcccctagaacccatcaaacactgttacaagaaaattgggaccgtatacctgatctacaggctaacacagatatgcctttcatcgctgctgacaatcaaaccggttatgcttggcatttgaaaaactcaaacctgactttgatctctacgttagggcccattgaaaagcctcgctataaaactcaaggcatcgtcatgattgtgaatgcagccaccccaaacatggcaaacaacgtaaaaggaacaagtctcgcacttgcgaaagcaactagtgtacgctgttgggaaaattcgaaaaaatctccggatcctctccgttcaaaacagcccctacaattaggagaatgccgctcagcaaaatgggaaaatctaaacggaaccacgaatgcaggtaaagcaggactaccgcaattcttaggacaacttctagggccgaaagcttctgactataactacaatcctaatgatgcgtttaccttttgtaggcaagcctaccttaactgtttgaatgaggccaagcgccgtaaaacaaccgtagttcagctccccttgctttcctcccatttccctggctctccaaaagacgaagagactactagtctacgtctgcaatggattgatggtgtgaagttagccttgatagatgctctgcagacatttggatcagaagcagaaaatcaaaatcaaccgtgggttatcattttgacaactcttgctagacatcccctcatcacaccctaatctctccccctggttaagcaaaagagagtagatgcctttttgtgaaaaggaaatcctttcttaaaaaatggtaagacttctctctttaaaacatccaaaacatagaagattttttaaaaaatcttttctaactttctaaaccacgctatactttctcaagcaaatagaaacgcctctgctctccataagacaaagcttttgcgaaataaagaaaattctaactaaaagacgatgcccgtgtcctcagcccccctacccacaagccaccgcccttcctctggaaatctaggcctcatggaaccaaattccaaagctctaaaagcaaagcatcaagataaaacgacgaagacgattaaacttttagttaaaatccttgttgccattctagtaatagaagttttaggaataattgcagctttctttattcctgggactcctcccatctgcttgattatcctaggaggccttattcttacaacagtactctgtgtgcttcttcttgttataaagcttgcccttgtaaacaaaaccgaaggaacaactgctgaacagcagataaaacgtaaactctcttctaaaagtatttcttagacaaacagcggtgtttttcactcattataaataaaatattttattccctaggtcatagaaaatatgagagtgtctcctcctattttagtaggagattaatttgtaaaacactaattacattgcatttaaaatagaaaactataaaattatagggcttgtcatagaaatataggaaatcacatgtcttctccagtagtcacaggaacatcaagtgcatctccagttgaacaaacaaagcttggagaattcctagaaaggttatcgggatcaggacgatgcataaaaattgcctttgcggcttcaactgctttactcctcctcaatacctttgtttctggaatcgttgctatagccatgatctttgtagcaacatctgtcggagcctactttacagttatagggcccttattcttgctctccctaatccttctggctatcatgttaatctcgatgtataaaatcacgcatccatcacaaaatacaccgatttcaaattagaaaaaagcgttcccaaagtacgagccccaagcactcctcttgggaactccttctctttgtcaaacttcgggattcgttctacgaacacaaaaacagattcgagttccttacgaatcgtcctctaaagcaaaatctttatccccttgataagtatgaaataattattttaattcacaataatctctccatatactctcttgatggcctgaaacactcggccatccaaggtcgtcgtttctctctgaaaattcctcttattgaggtgaagttctgtaaaattgataaatgtaggcatccttagagaagctttatcagcttcaacaaaattctctcggcttttataattgataaaactctgaaatttttgagatttttatgacactcattacccctgccatcaattcctcgcgacgcaaaacccatacagtaagaataggcaacttatacataggcagtgaccactcaataaaaacccaatcaatgacaacgacattaaccacagacattgacagtacagtagagcaaatctacgctctagcggaacataattgtgatattgtcagagtgactgtacagggaatcaaggaagcacaagcctgtgaaaaaattaaagaacgtctgattgctctagggttaaatatccctttggttgcagatatccacttcttccctcaagcagctatgttagttgctgattttgctgacaaggttcgcatcaatccaggcaactacatagataagaggaacatgttcaaggggacgaagatctatacagaggcaagctatgcccaaagtctcctgcgtcttgaagaaaagtttgctcctttagtagagaaatgtaagcgactaggcaaggctatgcgcattggagtgaaccacgggtcactttccgaaagaatcatgcaaaaatatggcgacactatcgaaggaatggtagcctcagcaattgaatatatcgctgtatgtgaaaagctgaattatagagatgttgtcttctcaatgaaatctagcaatccgaagatcatggtaactgcataccgccaacttgctaaagacttagatgctagaggctggctctatccccttcaccttggagttactgaagctggaatgggcgtggacgggatcataaaatccgcagtaggaatcggaactcttcttgccgaaggactcggggataccatacgctgctctctcacagggtgtcccactacagaaattcctgtctgtgatagcttgctacgccatacgaaaatctacttagaccttccagaaaagaaaaatcccttttccctacaacactccgaaaactttgtttctgctgcagagaagcctgcgaaaacaacactttggggagacgtctacggagtctttttaaaactctatcctcaccatcttaccgactttactcctgaagaactcttagaacacttgggggtaaatcccgtaacaaaagaaaaagcattcacaactcctgaaggggtcgtcgttccccctgagttaaaagatgctcctattacagatgtacttcgagaacactttttagttttccaccaccatcaagtgccttgcctatatgaacacaatgaggagatttgggatagccctgctgttcatcaagctccatttgtgcattttcatgcttcagaccccttcattcatacctcccgagatttctttgaaaaacaaggacaccaaggaaaaccgaccaagctagtattttcaagggactttgacaataaagaagaagctgctatttccatagcaacagagtttggagctctgcttcttgatggccttggagaagctgtggttcttgacttaccgaaccttcccctacaggacgtgctaaaaattgcctttggcactctacaaaatgcaggggtgcgccttgtaaaaacagagtacatctcctgtcctatgtgtggtcggaccctctttgatcttgaagaagtcaccacacgtatccgcaagagaacgcagcacctaccaggacttaagatcgctatcatgggttgtattgtgaatggccctggagaaatggcagatgcagattttggatttgtaggttccaaaacagggatgatcgatctttatgtaaaacatacttgtgtaaaagctcacatacccatggaagatgctgaagaagaattaattcgacttttacaagaacatggggtatggaaagaccctgaagaaactaagttgacagtatgactctatccttccacactcaccctctgaactattggactttcgaagaattcgatggtttgcctatacgccacggagtcttttcaaaacaaaaggatgccgagggcacggtcttcgcagccaagaatcctgagattgcttcagctctccaatctccgaagtattgcgaccttcatcaacgccacggcacttccgtacgttgtgttacacctacatcccccacctaccaacctgcagacggactgtgcacgcagtctccgctcctctctctccatatccgccattccgattgccaagcagctatcttttatgatcgagaacaccacgcaatcgcaaatgtacacagcggatggcgaggattgcttggcaatatctatgctgtcaccgtaggtactatgaaaaaattatttcatacaaaaccacaagatctcttcgtagctatcggcccttccatcggtccagattatgctatctatcccgattacgctacgttatttcctcgtagctttcttccctttatgaatcccaaaaaccattttgacctgcgtgcgattgctcgcaagcaacttacgaatttaggaatctctaaagaccgcatttttatctcagacctctgtacctacacggaacacgacgctttcttttcttcaaggtaccttgctcaccatcccgatcccaatctcacaggccaacattcaaaaaatagaaataatgtaaccgccgtccttctcctacccagagattaaaaagatccagccaagcttcttttcctttcccctaaggaccttagcttctagaagaacatgcttcgttccaacccactcagaattcagtaatcttcttgatgaaaaacaacatgtaaactacaatttttaggaaaaaattaagcttaaagactttctatgaaattaggcgcatcaactaatcataaagttcacgaaccagtgaagccaaaaaaagcgcaactcgctgagattgaagctaacaaaacccaagctacagaaggcacactcagaagtaaaagtcttgctcttcaaattgcgcgtgctgttctttacatacttttcgctgcactaatgttagcagctggaatcacgttcgttaccttcttagctttaggcttccctctaatacaggcgtatagcattgctggtattatcacactcgtgggattagccatcgggctcgtgcttctcatcttgagcttgttgcctaaagaagacgaggaagcagatgcactttctagaaacgctcttcttccattaaccatcattgtaatcgagcaacaacccatcactcctaaacctgagatcccctattcttatttaactaaactagccctattaacatcattgttccttaccttacgacgctcttcctcccaaagaaaaactcactaaagaaatcaaaattacagaagctacgaattgtgaaattcaccatctaaagaagggtccttaatttaaggttgtcacagctaaagctcctaatctcacagaaattagagatcacggggctcgcgtaccttcgctattcctcctttcaccagaaacttcgcattggaaaggggataaggaagtctcggctcccctaaagcaactgcaagatctcttaggagaggaacagtgggaagctatgaaaactaaaatgaactctagaaaaaaagcaggtcaatgggcaattttcaattctccaactcctggtgtcagttcaactttagttttagcatggactccttggggttattacgacaaggatgtacaagatatcttagaaagaaaagatccgatgagctcttcgctttctgaaaaagactcaaaggagttcttgaaaaatctgtttgtagatctcttagaaaatggcttcacatcagtacatattcacgcagaagaagctttcactcctcttgatcataccgggaaacctcactttaaaagagacaatgtgtacttacccggaaagttgttaggcgccttgaatgaggctgcggtacaagccaatgtaagtgcggatactcaatttacattgttccttactcaagatgagtgcaatccttttcatgataagaaaagaggttaaaaaatctgaaaaggctctaaaagagcctttatgagaatcagagaaattacaagtcgagtaatgaggcaggattctctaggccttctttcactttgactaaaaacccaacagcctctttcccatcaataagacgatgatcatagcttaaagcgacatacatcatatctgcaattacaatttcattatcaagaacaacggggcgcttttctatcttatgcatccccaaaatccccacttgcgggggattgataatgggagtcgaaagtagcgatccatatacgcctccattggtaattgtgaaacctcctccctcaagctccgctattgcaagtaggccttcacgagcccgaagggcaagatctgcgagtttctgctcaatctccccgttagaaagtttatcgcaatcgcgtatcacaggaaccacaagtcctcgatcgatacctacagcaatagaaatgtcataatagtgacggtaaacaatctcctcgccatcaatataggcgttcactcgtggatatgccttcaaagcctctaagacagctttcacaaagaaagacataaatcctaacttcaccccatatcgagatagaaactcttcttgtttttcctttcgcaaatgaaaaagaggtgtcatatagacctcattgaatgtcgtgagcatcgcagactcatgtaaagcagacaaaagacgccgcgaaattgtcttacgaatcgaggtcatgcgttctcgagtttctcctcgatctcctgcagaaagaccttgggatccttggtccatctgatcacgaagaggaataaacgttttattctctggaggagactgacgcaccccagactgaggaaagcaaatgatctcagcttctatagtctctttagactgagaatctccaagctcttccccttcacctgcgggctctatttttcccactaccccccctacaggaacaacatcgccttctgaaacctcccagaaaattcttcccgatactggggcataaatgagctgatttaccttatcactttcaatttctagtaagccctggttttcttgaatcagagcaccctctgtaactaacaaggaagctacggtcacctcgctaatcgactctgcaatattaggaatgcgtacttctgtagtcataatttaccttaaagaaaagagggtttccatacacgtgaccagctcttgacgactgagcttcgctgatccagaagctgtggaactactccgaggacgtcctatatatagcagtttctcaggaagaatgtcttgcaacgccataaacatatagtcataggcccccatattcttggattcttcttgtagccaaacaaaatgtttcaaatgagaatacttatcgataaggctcactaaatcctcaagagctaaaggatacaagctctctatacgcaagcaagaaaagtccttacgccgatcttgaggaagcatttctgcataatcataatagatctttcccgaacacaataccaaaatagaagcatcataattaggatcggcatcttcgagaatagcacggaatcccccaggttctgtgaactcctcgatactacttacacattgtggatatctcagcagcaacttaggagtaaagatcaccaaaggcaaagaaagatctctcttagcatgctctctgagaatccgaaaatattgcacaggagtggaaggcaagaccacttgaaaattccagttcgcggctaattgcaaataacgttctatacgagatgaagaatgctcgggtccttggccctcatacccatggggaagaagcagaacaatgtcagagtgtaaatcccacttctgaattcccgaagagatatactgatcgaaaatgatttgtgcaccattagcaaaatccccaaactgcgcttcccataacactaaagtctttaatgcctgttgagcatagccatactcaaaccctaaaattgcatattcggaaagaggagaattatacatttctacagagccctgctctgcagaaagatggtacaatggagagtaggtatctccagtcacagtatcactccataccaaatgtcgttggctgaatgtcccgcgaatagaatcttgacctgagagtctcaggttgtacccttcgattaatagcgaagcaaaggctaattcttcggccatcgcccaatcataaccaaccccaccttctgccattttcattcttttttctaaaagagtcttaattttaggatggggatgaaaattgtcagggaaaccacaaagacgcgagctcatatgaaaaagagtctcgcgatccaaagaaacatcacaatcatgcaaaataagctcgccgttatttaagcgatcgcagtgatgacattcttttttaggaaagggttctggatccgtccctttcaatacttgaaactcacgattcagactctcttgaatctctttttcaatagatgccaaagtttcttcagaaatatctgcaaactgcccttccaacagatattgcctaaacagctcgcgaatactcttctttctcttaatctgatcatagagtaagggagctgttactgagggatcgtcactttcattatgtccatacttgcgataacagcagagatctatgatcacatcacaactaaatctctcacgaacttgcagagcgtactctatagcttctatacaggcaacgacgtcctcgctattcactcgaaatacaggaatccctagcattttagcaatatccgtacaataaggggtggaccttgactcccgtggcactgcggtaaaccctatgtaattattcacaacaatgtgaagcgtaccctcagtagaataccctggaacacgactcagctggagagtttcataaaccactccctgaccagaaaatgctgcatctccatgaactaaaattgctaagctgctttgctctttacctgcgtgaccttggtgttgcaaggcagccacgaccccctcgacaataggatctacagattcgagatgactagcgtttggcaacatcacaaaggtagtttccctatctttctgatgggactttagcacataccctttatggtactttacatccccaacactctctaaaccacgtgctgcaggatcgtcttcaaactccataaagacataacggtaaggctttcccaaaacattcgttaatacattcaaacgacctcgatgggccattcctaaaacgtagttagaaattcctaatgccgatccataatgaacaagatgctccaacatggggaccaaggtctctccgccctctaaagaaaaacgtttctgacctgtaaattttatctgtaagaactcttcaaaaaacgttgctttacataagtctttataggagcgaaggagctgctctgcaaagcgctccacttgtcgcttctccataagattccaaacaaactcctgcaactcaggagtacatgttagggtttctaaagtaagacttccgcaatagcatttttttaaagcttcgatcagctctcgtaccgaaacctgagctttaggaagtagacccgcagaaggcacctgctcatccagatcaatcttagcgatcttttcctgaatgaatcgagaatctgtagttggggcaagcgttgaaatttgactttgcaaatatccataataacgataaatcgtacatagaaactgagatttttgttcttgaagcatagcaatagtttcattcccagaaatcttagtactagcttctgatggagatgctgcttgaccgagctgatacccttcaaaaaaatacttccaagaaggatccaaagtctcgtgattcataaatctctgatacatagactcgatccaatccatatccgaagaatatacttgccccacaaactcggaatccataaaataattaaactcaataaatacgatctaaatgtctgcttcatagcaaatttttatttttcaaaaaaaaaaaaatctttgttttttttctgcagttgaaaaaacaaaaaaatgctatgcacctgctctcgaatacaggatgggaacccttggatgaaaagcgaacgtcttaaaaaattagaatcagaacttcatgaccttacgcaatggatgcagttgggtttagtgccaaaaaaagaaattagcaggcaccaagaagaaatccgaatcttagaacataaaatttacgaagaaaaagaacgtctacaactcctcaaagaaaacggagagattgaagagtacgtcacaccacgacgcagtcccgcaaagactgtctaccctgatggtcctagtatgtctgatattgaatttgtggaacccacagaaacagaaattgatatcgacccaggcgaaaccgtagaactggaactcaccgatgaaggacgtgaagatggggcagtagaagtcgactattcccacgaagacgatgaagaccctttcagcgatcgcaatcgctggagacgcggtggtatcattgatcccgatgctaatgaatggtaaggctcccctagctctttatattcatattcccttctgcacaaaaaaatgtcgctattgcagtttttatacaatcccctacaaaagtgaatctgtatcgctctattgtaatgctgtaattcaagaggggctaagaaagctagcccccatccaagagacgcatttcatagagactgtgttttttggagggggaacaccttcattagtttctcctcttgatcttaagcgcatcctcaaagagctagccccccatgcccgggaaattactttagaggccaaccccgaaaatctcaccgtaagctatctacgtcaactacaagagactccaataaatagaattagcgttggcgtacaaaccttcgacgactctatcctacagctcctcggaagaacgcattcttcatctgcggcaatcacagcactgcaagaatgccagaatcacggattctctaatctttctatagacctaatctacggactgcccacacagtctttggagatattcctaagcgacctacatcaagctctgactctccctatcactcacatttctctatacaacctcactatagatccccacacctccttctataaacaccgcaaaattctagtccccacaattgcccaagaagaaattctagctgagatgagcctccttgctgaaaatctcctactctcccaagggttccaacgctatgaacttgcttcatatgccaagccagattaccccgcaaagcacaacctctattactggacagatcgccctttcttaggcttaggagtttcagcttcgcaataccttcacggagagcggtcaaaaaattatagtcatatttctcactatctacgtgctgtacgtaagaatctccctacccaagagacctcagaaattctcccaaaaaaagaacgaatcaaagaagccttagccctgcgactccgactccttgaaggagcagacctcgcggagttcccctccacacttatctccatgcttacgcaagatgtaaaattacaaaacctattcagtgtgcatggacaatgtcttgccctaaatagacagggccgtctcttccacgatacaatagcggaagagattatgggatattccttctaatccctgcggaaggctaaaacctagactctgcccttcggactcctgatgctccgggaaacatcagagaactcttaaaggtaaagcttctttctcggtctttcttttttttgccgtgctcttatgttaaaaataccaagatgtctccaaagatacattagcgacgacgacgcctagaatggcgtaatacggacttcacaaagaaccatagatttacgaacaagacgaaagcacataagatgaagtttaatgtttggccaacagctaatacatcaccactgctccaattttcttcagcacttttattatgtagatcataaacagcagtgttatttggacgtactaagatacgtggaacttgtattgcaatctggttaagcaccataatggataccggcaaataaagtcctccatgtacagtttgtaaaaagcctatgataaagcctgcacgatcgcgataagaagctcgtactgttcctacaggcaggccacttcctataactcgttgctgcacaaattgttgtacacgatgtctaagacctcgccccatccagcgagtgcactctacaaagacaatactccctgaaattgtagacgcagaaataaaaattgctcgtaagatttcctgaggcatccatagtttacgcaggacgttgccacaatcaaaaacaagaacaaggatgcttggtaaatatagagattgtgctacgattcgtgcagtacggaatctctctctagactgaggataatttgtaaagagtaagaaaaaataccggaccgcaaacgtcgtgtgcatcaaaattaaagagtaacagatctgcaagtctaagccctcatgaacagaggctaggatccattcctgcgcaagtcctgaaactctagaaattgcataaagcgcagaaagagctacatcaggacaccgttggggatagggattgatttccatatctgatgaaggcgatccttgattcaaccattctacaagcctactcatagaactaggatccgtagaatcaatgacaacagctagatctctttcactgtgtggtaactgtgatctttcggcatcttgagaaagacctcccctatcttctacatcctcacccctattcgcaaccaagcattgctctccaaaacgcaccgcccaagtaaaagaaggacaacggatagaaggcagaaaaacaccctcaagacccgaagaatacggcagtatcgtggtgttctccgccctagttccccgacaatccagagaactaaagaagtctccagaaacacggtaattatggaccctaaagtctccttgaataaagaccgtcggggaaatccctacaacaacaatacgtggactatgcctagattgcgttaacgcctgttgtatataaggcgatgcatccccatagaaaatcactagaaactcacgattctgattttcaggagcagagaaaaactgttcccaaaccgtcaaaagggcctgacataaaggatgatcgagagtaggaagagtacgacaaggactgatgggccaaggagacatgccgcttccatcgttatagagaagacgaacggcctctccccgtacttcactaatatacagcaattcctgtacagcttcttgatgcgtttgccaacttccatttacatagagagtacgtacctcagaatctgggggctcaggatcctcatcaccgccacaaaggcaaaccaactcatacacatccgaagccacagaagcagatgaagaacttctagggcctcctgcaatgaagaccgagatatcttcagccgaagatgcaactgttgatacgtctagagaaggaggagatattgtaattctcgggatttggatatcggcgggaataggatttggggatagaggttccgtttcttcgagtagtgttggtggtgaagatcgagattctgtgggtgctgtcatcaacgctctaaacttatttggcaaagattataaaataagtattgataacacgcaatagaggattacgattattttaaaaagacgcaaacctatgattatgcgctatttagaatcatgcaacctttaatttttgcttatgatcacaagaaaaatatccccgaagagcttacatgctaagaaactcctgacaatgataccggggataaaacaagctaagaaaaaattaattcgggatgtggaaaagaaatattgttgggactttggttatactttgcttcacagaacctaagtcctcagtagttctccatgattgcacttggcgtgtgagaacaagttcactcgggcccgaaaggtcagaggcaacacaaagctccgcataggaaggtaaagtatctagaagagactcaaaagtatagacgttacgataagaagtttctatacatactgaagtagatacctctttggaggtcgctgccttttttatcgactttacacgttccttaggactttgcgggaggtatcccaaaaacgtaaagctctgggaaggcaagcctgaaagcatgagcgctaacgttatcgaacagggacctgaaaaagcctgcacaggaatccccaaagcacgtgcacgacgcactaaactcgctccaggatctgcaatacagggaagacccgcatcagagatcagtccccaattctccccgtgttttacgataggctctagataaaaatcccaagccttagggaggcgcgcatgtttactaagaatagcaagaggaaatttatgaacttcgggaattttccataaacttagaaatgccctacccccacgatcactttctacaatcagcccatctagtctatgaactaattctcctataacggaggggagagtctctacagcacgggtaccgagagtattgggaagaagatataaagtcacaggttaaccattctaatcactaaagtttccacagctactataggatcttggacattatttttaattaaggtttctgcataaaataaagaatttaaggcttggtgtagtctctcctttccataaaggacgaacattcggtgtttattttctttcgatccctcttcaatactacgtaaaccatagagacattgggtacgaaggaaagtaataatccccaagggatcttcaccatcctcgagtagaaaatgcaactgctggtgaccttctaccggatccctcttcaatagagagtctcgaaatttccatagggaagccttttcttttttgacaacgagctctttaatatcagagtgatccaaggacgttttcttgccaacagagcacagtagcttatcgaattcactgagaatatcaggaagagaggttgaagcaagtgcacgcaaaaacaaagatgccaatgattgagagcaagaaatccccacacgctcagctctttgcaacaggaggcgtatgatccttttctgacgatctgcgggccactcaccaaataaactcaaagaaagagccgatggcaaggcttttgacagttctcgaaagcattcttgttttgtggtgaagatcaaaatcgtaaggtgaggttgaggattccgagcatagcggcttagaaattccttagttgctagagggaatttctctgcatgaataatccccaaagtttcatgctcttgaaagagtgcaaacgtctcggtccaagacatgagggttgctggcatgagtccctgaccaccgagctctttgaagctctcagagactaataattcaatcagcgcatctttatcgtcttccaaagcactccctataagagctatagcgggcactttctctgcatacgcctgggaaaagtcatcaaaactcgttaaggatttttgcataggtagagtcaaaaaagtagtatcctgaacctactatacgtattttcctaccaactgtacagcatgaagcctgaagatctcgctctataaagctttttaaccttaaaaagaaaaacgggaaggaaacccaatgtttccctttcccgttaacatgagcaataatgcgaaaatcacaaattatcgagacatcattttgatcagttggtgacgccagccatgagctgtacgaacacggcttttagagccatgctttctcgtagctgttgaagaacagacacgtttacaactagatgtatgcttatggtttttgtggcatgctaaagcacaggctgcagctttcttaggagaacctttagccactgtagtttttctagctacaggcttcttagcaacagtcttgcgaaccgctctcttagctgtagtcttctttgctactgtcttttttactacacgtttagcagcaactttcttaactgcaggcttcttagcaacagtcttacgaactgttctcttagctgtagtcttctttgctactgtctttttagcagccgtcttacgaactgcaggtttttttacagcggttttgcgaacagtagcttttttaaccgtacgtttagccgcaacttttttagcaggcttccgtacagctcttgaagctgtctttttaccgctttgctttttttgcgctccaatcatctttattcccctaattagacaggtaattacttacctgatctatcggcagggacgattgaaaactttaataaaaaaaatgacttttattttaaaaaaactaaaataaaagtcattactaaaacataaataaatagaaagcaactacttagaaagactattttctaagtaataaagaatagaacgaacaccaaaacctgaagcatattttggataacggtcttcttctttttcatgatatgcagtacctgcaatatcaagatgtgcccaagctaccgaagattcttccaaaaatctctgcaagaataatgctgctgtaatagcccctgcacggttactgcctagatttttcatatcagcaatatcagaatgcaatgttttatcatacttcttaactagaggaagtctccataacggctcggaggtttcggctgacgcctctaaaagatcttcagctaaaacatcgttattggaaaagaaacctgcaacctcttctcctagagagactaccatagctcctgttagagttgcaaaatctataatacgtgtcggtttacaatattttaaagcatatgtaatcgcatcagcgaggataagacgtccctcagcatcggtactacaaatctcaacagaaagccccgacattcctacatagacatctcccattttataggaggcgccatcgatagcattctctgtagcaggaatgatccccgtgacatttataggaagctctaaaactgctaacgccgagagaatcccgaggactgtagccccacctgccatgtcttctttcatagtaagcatggattttccaggcttgaggtctaaacctccagagtcaaaagtgacccctttccctatcaagacggtgtgatctttagacttaggacgtccttgataacggacaacgataaagtgtggatccacacaagaacccttggaaacagccaataggagtcccattttctctttggcgatggcatcttttcccaagaccttagtatcaatactagggaactcttttcccagattcagagcaacctctgccaatttcttaggggtaatttcatcagcattcctgttcacaagatctcgagtgagatatacgccttcgaaaatggctgcttctttcctaaagatagcatccgccattttgggaacgataccgataaccgtgactttagaaagaggagtttcaagattacgatctaccttattataacgtgggtagtcatagtttaatgacaaaattcctgaggacaaccccactaagaattcttcggcagaaagccgcaattcagaaattgtaggtaagatgatattgactgtggaacactttgctttacgtaagacacgagttagtgtcgcataggtttggaaaacaacatcagaggtgagctcttcatttttccctaagcctaagaggacaatgcgtttttccttagctttaggactactataaaggagttcaatctccccggtttttccttgaaagttttctaaagcggggagatacgagggttcaaactcggcttcaaaagaagctgcattttttgcatccttaaaatgccaaaagggcaggactatagcatctgccttaacacgattacgcccagaggcttgagcatgaaataaaaccacaaactctcctttaatgactaggaattaaaaaggaacatcttcacagacatactgctgttcttgaccataaccagcatacatatctttatctttaatagcttctgcgtccagtgcttcaccttcaaaccctacggatacagattcatatcccacttgctgatgattgtcttctaaagatggagaacggctgccttcattgcgaccgaaaggactgaatttcaaagaatctacactaatcactaaagaagattgcggtgaaccatctttgctcatgtaactctctacagagatatcgccagcaacaatgactcctgagcctttcttcaagtaaggaagcatcttatcatagcgattgtgccaaatattgcatttgcaccaaacagtttcatctttcattccaactcgagtcttcactcccagtctcagagtgatcacacgttttcctttggaagtcattcgctcttcaggatctgctccaaggtaaccagcaaaatgcccaaacatcataagatagcctttagatttctatttttaatacttctttaattaatacatcttaagaacttctcaaaacagattcaggacaaaaacgagaagtcaataaagtcatttcttctctaagaagagctttatcaatcttttaaattagaaaaaagatgtagtacttatatgcttaattaagcacgaatacctgtaggaggaggttgcattccaccaccgccttgaggcatttgtggcattgtatctacagaaggttctctaccagcacaaatatcagcacacacggtacgccacttaacaacagtttcaataaacaattgagcaaatgcttttagtaaattcgtttcagcatatttcatatccaaaacgcagtgcatgagaatgagctgttccttagtagcaacacctactccacctccagccatctgaccgccaagcatagatccttctaataatttctcatataaggccaatttcctctgagtattatcagggagtccatctaacagaggagcgtagacataaagacgatcagaatgttcttcataagtaaggtgaagagagaactcaccatcaacaaataaaatgcacgtgttattctgatcaaaagctacatccggcagttttaattctttagcaaaattttttagattttcctcagcattttgcctggacatgagggaatctccttgtaatagattgttgttgtttcaagttaccataagagtgatttgttagtaaacgatttcagaggcttaaaatcaaaaactcccttgtatttctggcgccgttatgatatctgatcgacgatggaaaaagtttcttcttatccctcagttcctttacctcttggggcttctaaaatttccccaaaccgctatcgatttgctttatatgcttcacaagctaccgaagtcatccttgctttaacagacgaaaattcagaagtcatagaagtccctctttaccccgatacacaccgcacgggtgcgatttggcatatagagatcgagggtatttctgatcaatcgtcttatgcatttcgtgttcatgggcctaaaaagcatggaatgcaatactcttttaaagaatatcttgcagatccctatgcgaagaatattcattccccacagagttttggttcgcgaaagaaacagggggattatgcattttgttatttaaaggaagaaccatttccttgggatggtgatcagcctctgcatttgccgaaagaagagatgatcatctatgagatgcatgtacgttccttcacgcaatcttcttcatctagggttcatgctccgggaaccttcctaggaatcattgaaaagatcgaccatctgcataagctgggaatcaacgctgttgaactcttacctatctttgagttcgatgagactgcgcatccttttagaaattcgaaattcccttatctgtgcaattattggggttatgctcccctaaatttcttttctccttgccgacgttatgcttatgcctctgatccttgcgctccaagtagagagtttaaaactttagtaaagaccttgcatcaagaaggtattgaggtcattcttgatgttgtttttaatcatacgggcttgcaagggacgacctgctctttgccttggatagacactccgagctattatattttagatgcacaaggtcactttacaaattattcaggctgtggaaacactctcaatacaaaccgcgcccccacgacccaatggattctcgacatcttacgttattgggtagaagaaatgcatgtcgatgggttccgatttgatcttgcttctgtcttttctcgtggtccttcgggatctcccctacaattcgctcctgttttagaggcgatttcttttgatcctttacttgcgagcacaaagattatagctgagccttgggatgctggcggtttgtatcaggtgggctatttccccacactgtctccaagatggagtgaatggaacggcccgtatcgtgataacgtgaaagcatttcttaatggggatcaaaatctcataggaacctttgcttctagaatttcaggatctcaagacatctatcctcacggctcgcctacaaattcgattaactatgtcagttgccatgatggttttacgttatgtgacactgtgacttataaccacaaacataatgaggctaacggagaggataatcgtgacggcacagatgcgaactacagctacaatttcggaacggaagggaaaacagaagaccctggcattcttgaagttcgtgaaagacagttacgaaattttttccttactttgatggtctcgcaaggcattccgatgattcaatcaggagatgagtatgcccataccgcggaaggcaataacaaccgttgggctttggattcgaatgcgaattacttcctttgggatcagcttaccgcaaagcctacactgatgcactttctctgtgatctcattgcgtttcgaaaaaaatataaaacactttttaatcgaggctttctttccaataaggaaatcagttgggtagatgctatgggaaatcccatgacatggcgccctggaaatttcttagcatttaaaataaaatcgccaaaagcgcatgtatatgttgcttttcacgtgggagctcaagaccaacttgcgaccttacctaaagcctccagcaactttcttccttatcaaatagttgccgagagtcagcaagggtttgtccctcaaaatgtagcaacgccgacagtgtcgctacagccccataccacgctaattgcgatcagccatgcgaaagaggttacctgatctctccgtccagttcttcattccaggattctataactacaaaatccacatccttgtagaacttctcaagaatctgacgtgcattgaatccttctatagcaagacgatctacgttggactgcaagagcccttgtgcatctataattaatccttgagggctatccacaactaaacgagctgtccagtctatagcctcttctacaccatagaactgcttggtcacaccaaatcctgcatacccttcttcttcagctttaacatgccaaaagttttgaggatttcttgcaaggagcttttcgtatagagcggttctttctagaatgatgcaagcagatagagcttctttatctagctcttcaaggtactttatagaaagtacagatttcagataatcttcgattgtaacttcgttagaaaccatgatgcaatggttgtctttacgatgaacgtatagggaaccttgatactgaatcccgttaaaaaaaagagaagcagtgtcatctacaggctcgatctttaaacactggagtccgggataaaattctccccaacggatcccttcgtatagagcgtggaccacgcaacgctggccttgaatcgctgtgtctaataagacattatctccataaatgcgataaggacctttggcttctatgagagctgtggtgctttcattagataaaaggacacgaattttaggttcaacgacagtatcctgcttcacaaaagtatcggatacctttacttctgagaatcctgagatactcatactgaagaaaagacctaaaagtacgtttttcaatagtttcactgtccttctcctaaactcaataagttctttgcatgtctttttaaatggtcgtaagcaagttgtgttaccattctgcctctgggagtctttttgataaaaccttttaaaattaaaaacggttcataaacatcttcaagagttttgatatcttctcccacagctaccgataaggttttaattccaacgggaccaccttggtagtagtcgatgattgtagtgagaagtttgatatcaatttcattcaatccccaatcatctattaatagcatagccaaagctttttctgctacgtccccattgatacagtttccttctcggatctgagcaaaatctctgacccaacgtagaagatgatttgccagtcgtggcgtccctcgggatctcttagcaatttctagtaatgcggagctgtcagcttcgattccgagtaaatgtgaggagcggactaaaatctcttttagatcttgatccgagtaataggaaagtctcgcactaaaagcaaagcgtgctcttaaaggttcgcttagcattcctgatcgagtcgttgcccccactaaagtgaaaggagcaagatcgacacggaccgagcgagctccgggtcctgaatctatagtaatatcgactttgaaatcttccattgcagaatacaggtattcctcagcaactttccccatacgatggatctcatcgatgaaaaacacgtccccttcttgcaaactagttaaaagtcctaacaggtccgagggtttgattaactgaggccctgatgccaagaccagccctttccccacggtgtaggcaacgatgtgagcaagtgaggttttccctaagcctgggggtccaaaaaacaagcaatgtcctggaacttctcctcgttgcaatgctgcgcaaagaaatagatctaggcgttcttttaaatgatgctgtccataaaattcttctaaccctttaggtcttaacgaaacatcaaattttttatcctgatgcaagacagctacttgatgcgtcatgtacgaaccttctctatcgctttttctttaggtggattttatatttttttgaaactctcatcgataacgccgatcggttatactcggcatagtacacgagatactatatagaagtacactatggacctcttctttctatcaaggagagcagggccaaagtacgagcactagaacctctccatcattttcattttatgatttaaacttcctgtggtgatctagatttcttttgtcttaaaacagataaattaaagatggcgaactatttttaaaaacattttccactgagaagttggtagtaaaaattctctagcttatcaataaggagatgttaatctttttatgaatccaagaagttcttatcaaggtcctcgcatgaatgcattcaagagaaccaagattcttctactataagagtaaagagcagacctacctgaagttctccctaaaaataaggtttgcctttttcccttaggattatctaacattacctctaggtttcgtgataaaattgtagcctttgggataggcttttcttgtttatacaactggtcttttcaagagataatcaaagtctatcttatacttagaaaagttccccccaaaaaccagtaaattgaaaaacagaatatcattaagaaagcaatttcaaactgttaaggtttctaaatgagcataaaagaagataagtggatacgagagatggccctaaatgccgatatgatccatccctttgttaatggccaagtgaacgtaaatgaggagacaggcgaaaaacttataagttacggcctatcgagttatggttacgacctccgcctatctcgagaattcaaagtgttcaccaatgtctataactctgttgttgatccaaaatgctttactgaggatatcttcatctctattactgatgacgtctgtattgttcctccaaattcttttgctctagctcgtagcgttgagtatttccgaattcctagaaatgtcttaacaatgtgtataggaaagtctacatatgcacgctgtggaattatcgtaaatgtcacaccttttgagcctgaatgggaagggcatgtgactatagaaatttctaacactacgccattgccagcgaaaatttacgctaatgaagggattgcccaggtcttattctttgagtctagtacgacctgcgaggtttcttatgcagacagaaaaggaaagtatcaaaagcaacaaggcatcaccgtaccttgtgtctaaagtttcagtaagaaaaaaaaactggggttttagattactagaagaagtgatgatcaaatcctggtgggtgatctttagcatcttaattggaggctttgtttatgatcgtgctatccaggagttacgtacagaagagctacgcttacaaagcaaggtctcttctttatgccaagacattctttctgctcaagaaaagcagcgtcaactccaattacatctgcaacactggcaagactccgctgctatagaagctgctttaatccagcgtctgggtctcattcctaaaggctataagaaactctgtgtctccccaaagcaacaatcagaaaataaggactgaaaagagaccatgattcctaccatgttaatgttcttcattatctgttttactttatgctcgggattcatttcgttatctcaaattgctttgttttctttgcctacgagtttgatctcgcactataagcgctctaaatctaagaaacagcagcgagtagctacccttcttctacatccccaccacctgctcatcaccttaattttttgtgatatcggactgaatattgctattcaaaactgttttgccattctatttggagatgcagcttcgtggtggtttactgtaggtcttcctttagcaattactttgatcttaggtgagattctccctaaagcagtagctcttccttttaatacacagattgctagttccgtagcccctcttattctttgtgttactaaaatcttcaaacccctactccactggggtatcgtaggaattaattatgtggtccaatggattttatcgaagcaacagattgatatcatccaaccccaagagctgaaggaagtattgcaaagttgtaaggatttcggcgtagtcaatcaagaagaaagccgtttactctatggttatctttctcttagtgattgtagtgttaaagagcgtatgcagccacgccaggatattttattttatgatatccaaacccctttagagaacctctatcttttattttctaaacagcattgctcacgagttcctatatgtaacgataacctccaaaaccttctgggcatttgcacagcgcgctctcttcttttacatgacaagccactgcaatcttcggatgatctcctccccttgctgaaaaaaccgtattatatgccagaaaccatctctgcaaaaatggctttatgtcagatggcagctgaagacgaaaccctagggatgatcattgatgaatacggatctattgaaggattgatcactcaagaagacctctttgaaattgttgctggagaaattgtagaccagagagataataaaatactctataccacctcaggagctgatgttattattgcctcaggaactttagaactccgtgagtttagtgagatcttcgatatcaacctaccgacgaacaataatattgcgactataggaggctggttaatagagcaaatcggaacgattccgacaacaggaatgaaactctcttggaataacttgcttttccaggtattagacgctgctccgaatcgcattcgccgtgtgtatataaggaaattgtatgactaattctgctctcttttggataggagtcaacattatctgtattgtcttacaaggattctattcgatgatggaaatggcctgcgtgtcatttaaccgtgtacgattgcaatactatctgactaaagatcataagaaagctcgctacattaatttcctgattcgccgcccctatcgtttatttggaacggtgatgttaggagtgaatatcgctctacaagtcgggtctgagtcctcaagaaattgctatcgagctttaggaatcactccagattacgctcctttcactcaaatttttatagttgtgatttttgcagaacttctacctctaacaatatcacggaagattcctgaaaaattagcactttggggagcaccgattctctattattcccactatattttctatcctctgattcagctcataggaagtctcactgagggtctttactatcttctaaatattaggaaagaaaaattgaactctacattaagtagagacgagttccaaaaagctttagagactcaccatgaagaacaagatttcaatacaattgctacaaatattttctctttaagtgcgacttgtgcagatcaggtatgccaacctttagaacaggttaccatgcttccttcttctgcaaatgttaaagatttttgccggactataaaaaatacagatatcaactttattcctgtctatcacaaggcccgaaaaaacgttattgggattgcccatcctaaagactttgtcaataaagctcttgatgaacccctaatcaataatctacactcgccttggtttatcactgcaaaatcaaaacttattcgtatcctcaaagagtttcgagacaaccgttcgagtgttgctgttgtcctcaatgcttctggtgaacctataggtattcttagtttaaatgcaattttcaaaatcttattcaacactacaaacattgctcatttaaaacccaagaccatctctgttattgaaagaacgtttcctggcaactctcgcataaaagatctgcaaaaagaactcgatattcaatttccgcaatatcctgtagaaaccctagcccaattggtattgcaactgctagacagtcctgcagaagtaggaacttctgtaattatcaacaacttgcttttagaagttaaagagatgtctttatctgggataaaaaccgtatcgattaaaaacttactctcatagattctgcaataagagtcaggagtgttctttcagcttagaaacatgttctcttttaagacttaggaatttttcaaacgttctacgactttttctataattccaacggctctttcaacatcttcttgcaagagaagatggctaaaagaaaacctgagtgttgccagggtcaactcttcatcaacacccatgctgacaagagatttaaagggtgcggtagcacctgaagagcatgcggatccataaccacaagccactccttctatatctaaggcgatttgcaatacctcaccttccaacggagggaaagcaattgctgagacgttgtttgcccgtggttgatccgcacaatgaatatggacatcaggaatgcgtgctttgattgccttttcaaaaccatttctatgggtaagaatttcctgagagatacgctcttgatgaagatctaggtatttgaaaatataaagcagagaggcgattccccaaagattttctgtgcctgcgcgcagccctccttgctgacctcctccccacagctgaggatgtagtttgactcctggagagaccagaagagctccgattccagagagtgcatgaaatttatgtccactgaatgctgccatagtgacaccagagggaagaactatcctctccttacctacatttgcagtcgcatccacaataaattgcaattgtcgttcttgcgcgaagtgggctatagcagctatatcagctttggcaccagtctcactattgacccaacctaagatgattgctgaagttttaggagtcacagctctttcaatctgctctatagtaagaacacatctcccttcttcgggatttaaataagaaacggaaagcgaggaatgttttaaaggctctaagatggcggggtgttcgctacctgaggtgataacatgactgtctttagggaggcttgctattgctaaatttaaactctcagtagcccctgaggtatagaggacacggccctgaaacgaaaggaccttttgcatccagtgtgaagcttctagaaccagttgacgagattttttacctaattgatggacgctcgaaggattcgcgtacgtcccttctataaggaaggttttttggagaaattccaaaagtcccctctctgggggtgtcatcgcattgttatccaaatagatcatggaatactatccttagcaaaggaactattgtattcggactaatacgacagtagcgttgtcatcgcctccacgagtattggctagagaaattaatgcattcccccgttcttctagggtggcgggctggttcaagatatcacgaatatcgatatctggaaccatgtttgtcaatccatccgaacagaggcagtacaaatcttccttttcacaaggaagattccgaatgtcaggcatgacatagggacgacttcccaaaacattagtcagaatatggcgataagaatacaccttatctgattgtttaggaagcccataacgattttttaattgattttctaaagaatggtcttcggtaaggcggcgcagttctccctcacgaatacgataaattcgactatctcccacatgaaatagccatgccctatccttccggaattggatgaagctaagagtggttcccataccctggagatgctcttccatttggccgtgttcatagaccacaccattgacctctaaaaggatcttttttaaagtctccttatactggtcatccccataccccatcaattttgactgttgctcatcaatcagctccataaggctagtcactgcctcttgagaagcaatgtctccaccaagacgccccccaacaccgtcagcaatagcaaccacttgagacatgaggtttacctgccaaaaatcttcatttctagcgcgcaccctaccaatatcactcagaccaaaataatcaaaatccacaaagtgctcctaaagagatcctggatcacaaatagagtccgcccctatagacattctctaatttcatatcattattataaagaattgaattttcctgacgaaatcataatttatcgctaaattaatggtcgcatgatcattaattacaaagaaaaatttgataaataatcgccctagagctaggctggaaaggtcaattaacctaaggatgaataatgaaaaaagcattctctttactattatcttgtttagtattgttagctcttagtggttgcgtccctcctcaataagggttcaactacgcaccatgagttttaatcacaaactcatggtgttccttagaagttcactaagaaccttttcatcatagtttttatgatgataaagtaaaaattgctataaatcgaagaactgcctatgcaaatagaaaatagtagtattctttttgcagaggtagtcatgaagtggtttattttttctgtgatctcagctccagttgtattcctcccagggtgcacattgattcctaaagaaaaagttaccaaagttccctcacaactttggtcagaatccctttctcaaccttgagtttctaaactaaaactgagacggtctctttgcttgtttttatttttttctttgatataagctaatgagagttttaaatggaaaatctctcaattgcgaaagtattgatcttaaaagtaaaaactttcccagggctagaatcttttgcaaaataagcaatttaaggacagtgactatgcgaaaaatgttggtattattggcatctttaggacttctatccccaaccctatccagctgcactcacttaggctcttcaggaagttatcatcctaagctatacacttcagggagcaaaactaaaggtgtgattgcgatgcttcctgtatttcatcgcccaggaaagagtcttgaacctttaccttggaacctccaaggagaatttactgaagagatcagcaaaaggttttatgcttcggaaaaggtcttcctgatcaagcacaatgcttcacctcagacagtctctcagttctatgctccgattgcgaatcgtctacccgaaacaattattgagcaatttcttcctgcagaattcattgttgctacagaactgttagaacaaaagacagggaaagaagcaggtgtcgattctgtaacagcgtctgtacgtgttcgcgtttttgatatccgtcatcataaaatagctctcatttatcaagagattatcgaatgcagccagcctttaactaccctagtcaatgattatcatcgctatggctggaactcaaaacattttgattcaacgcccatgggcttaatgcatagccgtcttttccgcgaagttgttgccagagttgagggctatgtttgtgctaactactcgtagtctaaggaaatgtccaagtttattcttctcttgtcccttggcgtcgctgctctagcttccaaaaacttctttatctggccagcaccctctgggaaaacacctttaaagctccgccaagttttatttggtggtgctcttcttgttttttcttcccttgtagctcttagcgtgagctcacaaactgcggaattactttccaccatgacaggaattagccttgcctttgcatttctgttctacctgctttttctccccaaggatatcacacgtgctatacttttctctggagaaagaccggttaaaacttcatggcgtgctctaggatctgccatcagaatgtggatcatcatcatcccagtaacacaactgattgggattatgatgagtaaatttttaactttggttcttcctacgcaagagattcacacacaagaagtcactcaagaagttcagaactctctgcctataacaggacactacattagcatgattctaaatttaggcgtcctcactccatttggagaagaggtattttttagaggaattctacagacattcttgaaaaacaaaatgacgcgcatagctgcggtactatgctcttctattattttctctttcattcacattgaacactctttaggaagttgggtctttgtccccgtgctctttgttttttccttatctgcagggtttctatatgaaaaagatcggcacattctttctcccattgcactgcacgggttgtttaacctcacctcattgctatttttgggaataaagtaaaaagagtaagttggagaacattcttttagcaaaagaaaactctccttagggctgctaccttccagtcctgacccgattcgcaggttccttctcttaaaaggcccccaacttacccttctttgatagcatatattctgttttttcaaaagcaccatatgcttaaaaatagaccaaaacttcaactatgtagattcatttttctctcggtgcttagcaagctcccaaaggcgatcggcctcttcaatcgagaccggcttgtaatcttcagcgaatatataaggagcacggcgacgcaatttttccatagcctcattggcaacgtcttcggaagcaagtacgccctctcgttctaacagaaaacataaaattagaactaaagttaagacatccccggcttcggaaccaacctcttgtaccgtcttaccttgtaagacggcctcgtgaaattcctgacactctccaagaatatgctctaccatagagactagggattgctgaagtgaccaaggacaacgtccttcaactaccatggcacggacagtccctatcaatttagaaaaagcgtgatctcgcatctatactcctattgattctctagacctgacatccccgaggtagattagcaaagcatctttaatctttttgtgtcctgaagaaaaagctaagtgatctatatcactcaaaagatgcaattccccgaactgaggcagagaagtggctttaaaaattataggacacaaatgaaccttatgattagtaaacgcatgccgctgttctttaaggttacctaagaattccaaagggctttctaaagaaagctccatcttcttagtaaatccttctatatcttgaagaccttcctctggttcaacttcaatataaggaaattcatataagcctgccatcatttctttaggacgtctcttctcgacaaccaaagagccatcgtacaatacaatcgctaccaaacgatgcaaaaagatgaccttttttctggcatgacgtaccggcaatacgaactgtttgttctccctccaagctccacatgcttgacggacaggacaacgatgacattgaggaacttttttacagatacaagctcccaactctatcagagcctcagctataacctcgggactcttatgaggaagaagcgcttgagcaatcctagaaacccaagtacgagttgattctaagtctatagaagtttctatcaaaaatatccggctaagaacacgcaagacattgccatccacagcagcagcacgcctcttaaaagcaaaggctagaatagcatgaaccgtataaggaccaactccacgaatttgagctaaggaaatggcatcatcagggatctttccatgaaactcctccataaccatgcgagctccctctaaaagatggcgcgctcgagaataataacccaatccctcccataacttaatgacatcttcttcttttgctgcagctaaagactctatggtaggaaatctctccatccactgattaaaataatctataacaacttcagctcgcgtttgctgtagcataacttcggaaacccacacactatagggagtcgggttatctctccaaggaagagatcgtttatttttttcaaaccatttttttaatgcctctacaggaaaattctttgccttttcagaaaaagctatctttgtcatacaaaatctcttaaaattttatgcaattatcaaatgataaaagggctgctttacaatattttatggaaaatttttcctggcttgccacacaagtctcaagattatcttcttttcttagatctcaactgcctaatcatagcaagcaagaaatcttggcgtctattcgccaacatcgatgtcgagtgaacgggttcatagaaagatttgaatcctacaaggtacaacctggcgaccgtgtttccctatctctgatcccctcaacaaaacaacaacctagcatcctctgggaggatgactatagcattatctacgaaaaacctccccatcttactactgaacaaatggcacacatgacacggttttttactgtgcataggttagacaaaggcacctctgggtgtcttctcatgggaaagtctaaacaagcggctactgagctcatgaaattgttcaagcaaagaaaaatccataaacaatacatagctttcgtttttggtcatcctaaaaaaaaatttggaaccgtaaaatcttatacggcccccgtataccggaggtgtggagctgtgatttttggagccgcaggcccatcacagggagaacccatcaaatccgcttacaaatgggattgctgggtcatcctattgtcggagatgtcgactacggacctaaagaacagcctccccagatcttccgccctctcctccatgctcactccctagaatttatctccccattcacaaatcttcccctaaaaatttgtgcgtcatcaaccgaagatcctagagaatgtgctcggcacttacttcaagaaaaacccctagaactttacaattagagattcataaaactgtaattggagtcgtttacactgcttcaaaacataacctcctcttcttcatcttctaaatcccgcctttctacccttccggggtgcgacctaggagaaatcacacttaaaggtaaaactacaggaaaacgccctctagaagacacaggggaacgctctctagcacctaataaagaaggttgagacgtaaccacaggatctggttgaggttgcggatgtgccgtgactccagaaggtgtgggtacaggggggcgttgtaaatttagtcccgccgtatgcatcaatgaagttgacatctgtagtaggcacttatctctttcttgaacattgttagcatcgcttaacaaacttgttttcgtaagagaattctcaaaacatcgtgcagctaattctaaatagcgtgacgaggaagattctccccctcgcttcctttccagatcgacacgcatgcccatcccccgagccaaaatagcattgacttctggattacctaaaatgttgccacgttggggatctcctgtggctgggacaaaataacattgatagtgagataaaaccaaagcaactaacgccatcagattttctttggtgatccaaatcggagtgcttcctccattggtagctacaaagaaaatagacattaatagattcatgcaggatgcagacaactggattcccatgttctcgcacccgttctttttaagggagaagaccttaagtgatgggaaagacatacatatcctctctaggttaaaagggctacaaacctgtgctccttgctctccccatgaagaaagaaccatcactttgctttcacactcgaattccgtttcctgaagagaagacttagcaatccctgaggcaattgctgtactccaaaaaggatcctgtaataaaccatccacacaactcgccgcatccgcccacagatccatgctttgagacttcaagatctcacaaaagtccatagaacaccggtcacatgcagccatgacctccgcgattggaggaaatccctcgagtcgatgtcctgataataagctcatggtatcaatgccaagctcacttaacgcaattaaaagaacagccttgccatatttctgttctaaagcctcgagttcttataaagggattgcgggttcttgggatccctctcctatcccgcaacaatttttccatacaccacagaaaaaacggccaaatcctccacaaccgcactgtccgtctggacagccacaggtaggacaaccgcagttgccttggcaggtctctccacaataattataacaaaattcgctagttttctttgctccaggacttgttactgctgcataaatgatctgtgccaacgatgcagctgtccctaaaggatttgctgctgcagatcctgttgccgataacaaattcaacagtaccgaagcggcctgtcctgcctgagttccaccacttcctccttgagacgtagtcatctggctcaccaagctaaggagttgctgtaattgctctgaactcacggacgatccgccacttcctgttgtcttgtctaagataagttgcaaaagctgttgctgcatacttgcactggaagaggaggctcccgaagttcctgctgaagttgatggttgtcccactgatggttgtcccacatttaataaattagtaagcaacgcttgcacttgatcaggtgaaagtcctaatgcagaggctccggatgcggtagtagttgtcgctgtagaggaggcagctcctccagtttgaagaaaaccttgaactgcagatgagactgcttgtggtgttgtggaagaaggcgctatcgtaacaacctgtggattctgtggtgaggggaatttccctaaaggattcgtcaaacaacctcctaagtaatcagtgaaacccaaactacgataagttcggatcgtaaattcttttgaaaatttttttagcagtacgcgggagtgagaagtttggatattctataaaatatgtaaagaaaaaaatttaaagaatttacgtttctatttacattggaggcaggatctcccctgttgaggcaccaaaaggttttcttaataatcgaaagatttgttactctccttccaataagcttcaaaagtataaggcggattcatgctaaagattgatctaacaggaaaggtagcatttgttgcgggcattggtgatgaccaaggatatggctggggtattgctaaacttcttgcagaagcaggagctacgattattgtaggaacatgggtaccgatttacaaaattttctctcagtcttgggaattaggaaaattcaatgaatctagaaaattatcgaatggcactctcttagagattgctaagatctatcccatggacgcaagttttgatagccctgaagatgttcctgaagatattgctgaaaataaacgttacaagggcattacgggattcacgatatcagaagtcgcagaacaggtaaaaaaagattttggtcatattgacattcttgtccactcgctggcaaatagtcctgaaatttctaagtctctattagaaacatcaagaaaaggttacttagcggctctcagtgcctctagttattcttttgttagccttctctctcactttggaagtatcatgaaccgtggtggatcgacaatatcgctcacctatttggcttctatgcgcgctgttcctggatacggagggggcatgagttcggcaaaagcagctttggaaagtgacaccaaaactcttgcttgggaagcgggacgccgttggggcatacgtgtcaataccatctctgcaggacctttagcaagccgagctggaaaagcaattggttttattgaaagaatggtagactattaccaagagtgggcgcctattcccgaggctatgaatgccgagcaggtgggtgccgttgcagctttcttagcatcacctctagcttcagcaattactggtgagaccttatacgtagatcacggagccaatgtgatgggaattggtcctgagatgttccctaaagactcataaggtcgtcataatagcggacaccagcttcccaagctgaaagaatgccattcttatctgctgggggagctagaaagtccgcatgaacgtgcatctcttcaggtgcggaactcatcacaattttaaaatctcctctctcaataagatcgagatcattagcatcatctcctgaagccatgacaaagggtttctttccatcataaagtatattgacaacacgatctaaggctttgcctttagagacgcttttatctgttaaaaacaagatggcatagcgaaagtcaaagggccagcgcattaacgtcatcgtcgcgactgaagtcagtgcttcttggcgttccagctccttttgaattctgatgacctcatctcgcagtccaaagacttttgctgcagcaaaactaggaaaagcatagtcgtcttttaaagagcgcgtttcaaataggatctctctttccttagcattaggaaagtacctaggatctacatattcgtgtaaatcttgagctataggagtcggtgaaaagcgatagtagtgatccccgtaaggagctcctgattccacggaaaaaagagccgttgccccctccatacaatcttgtaaaatacataataaatctgagggtaaacttttagaatagagaagatttgatgatgttgaagaccatacagaagcgccgttttggcatcctaataaatatggagcatcaaaatcagaaaacaagcgtgcagcatatttataataccttcccgtcaagaaaaacaacttccaaccagcttggtgcagcgcatagagccgctcatacacctttttatctaaatgatgagattgatgggtaattgtaccgtcaatatcagtcactagtaacttttccatagcatcaccatagttttattaagcgctgccaaggaatttctcaggcaacttgaaaaaattctttgcatccaccgacagactgctgtcgttttgtctatgaaagacaagagcttgggctctgtggaacgagcacaccctagaagggtataaaggagtctgtgaattacccaaatcatctaggggagctctctagacggtacttgcaggaatatacatgattacggtttaatctgtacttggaaatcattgtactataatttatatagcatcgactaaaactatacttcattattacttgtatgtagttggatacaaatcgggctaccactataattttatagagatgatcgcgggtcttacacatgttttttaatcttttttctttagtttttaagctttctgatgagcttgctcttgcagaaacgatccaagagcccatttctgtacatgaaatgttcccaggaagcatgaaattagaaatgtttaaaatgctaggatctttgattctacttttaacaatttttggctttggagtttgggcgtttaaaaagtttgtgagatcaagaagtcacggttttggaggctcgtctcaaatcaaaatcctagaacgacgttccctaacgccgaaaacttctatttacctcattcgagttgtgaataaaactcttgtgattgcagaaacaccagaaaaaattacgctactgacagagtttcctcccgacactgatatcaatcatctacttcaagaaaataataagcagtcttcttcctctgcaacctctgatttcctcagtaaagcaatacaaaagatacaaaaaaaacaacagacgaatcaagattagatctagtattatcagccagcaatgatgcaggctctaggaacaacttggagtatttcctaaatgacgacatggacattaaatcaaaataatctcacaaaatttcttaaaagttcggatgaagaacctttcttagaaagagaaagcggtcttacttacattaacattcaagctaatggcaatgaactccctttattttttgtaatccgcagtgagggagaaatactgcagttgatttgttaccttccctaccaattgcatgaatctcataaggcatcaacagctcgtttactccatctcttaaatagggacattgatattcccggctttggcatggatgaagaacagggattgatattttatcggcttgtgttgccctgcctaaacggagaaattcatgacacactattacggatatatatcgatacaataaagctagtctgtgatagtttttctcatgctattgggttgatctcttctgggaatatgaatttggatgaactaagacgtcaggctcttcaagagcaacaagaaaaacgtaatgagtagtcaaactatggatgttcttattttctatgatacggagaccacaggaacacaaatagaaagagatcgcattatagaaattgctgcctacaatagtgtcacagatgagtcctttcttacttatgtgaatccggaaattcccattcctgatgaggcatccaaaattcatggaatcactacggatgcggtactttctgctcccaaatttcctgaagcctacgagggatttaggaaattttgcggagaggacagcatcttagtggctcataataatgacggttttgatttccccctactcggtaaggaatgtcgcagacattccttagagcctctgacaaaccgtacaatagactctctaaaatgggcacaaaaatatcgccccgatctaccaaaacataatttacaatacctaagacaagtttacggttttgctgaaaatcaagcacaccgagctctagatgacgtagtgatattgcacaaggtatttacttctttaatcggtgatttaccgccccagcaagtcctcgacttgctgcaacagagctatcacccgaaagtcttcaaaatgccttttggcaaatacaaagggcagcctcttgtggatattcctaagtcttacttcgaatggctggaaaaccaaggagctttggataagcctgaaaataaagacatcaaagccgctatagctctattacatcaaccgacatgatactgactgctgccttttctccttgcccgaatgatattttcctttttcgttctttcttaaaagacccccaattcaggcctcttcttaaccaggtaacaattgcggatattgaaactttgaataccctagctctgcagcgacggctctccctaatgaaaatgtcagcagcgctcttccctctagtttctgattattataatcttatggacgtaggaaataccttaggatacaacagcggtcctatcgtcctctccttagatcctgaatgttctctagataccttggcaactcctggagagatgacaaccgctcatgctctctgtaaactttactatcccaaggcaaaactcattcccatgccttatgacaaaattctatccgcgatactgcaagggaaagtcgatggaggcgctctgattcatgaagagcgcttcagctacgatctccaattgacattgcgggcagactttggagagctatggcgccgtaagaccatctttccccttcctttaggatgtttagccattgcgaaatatgttcctatggctacagtggatgctctaacagcagcattaagaaagtctttaatttgctccctgaaagatcctataactgcgggagcaaaagcagtagaatactctaaaaataaaaacgtgaccgtgattcatagattcataggaacctatatcaacaaagaaacctttcaactatctaaaactgggaaaaaagctttacatatgctctggaaggccaatgaatgctgtcaatacacctaaaaaaatcctttgcattgttgcagactatagagaaatttctcctctaattgaacaacttgattttacacagatcaacgagcatctctatagttatcgttgtactgactaccatctagatctctatattgtccatgtttggggaagtacagccgttttaaatgctcttcaaagctattgccaagcatatacagattacgatctgtggatcaatccaggttttgtgggggcatgttctcccgagattcctttaggtcaatgttacactattgagaaaattgcaaacctcactacggatacacctcctgttctctctgaagatcccccttatatctttgacgctctaccggattctctacctaaaagctctctggttacctctccagtattgtaccattatgggtttcataagacgtttaaacttctagatatggaaggctatgctatagcctcacaagcagcagaacatcacatcccctgttcttttctcaagatcacttctgattatactgttccaggagactgtcccttcagcagattggaggaggtatcacaaaagctaactcagacacttgtagagttgttgcctgagctcatggagagagcgatcccacctaagttgttattgccatgtccgtaggatttgcgactaatttgtgatcaggaacaaagaccctgttatattctttagtccctgagagctcccacatttttaaaaattcaggacacgtctgtaagagttcttcttttgtgccttcggcaattttttgaccattttctatgtagagcacgcgatctacatgttcaagagtggtcagcttgtgggcaataatgatttgtgtgcactgtcctttaagctctccaatgatattcttaatgtaattttcactaatggcatctagagctgacgttgcctcatctaaaattaagatggaggcgtttttcaacagagcacgtgctattgccaaacgttgctgctgtcctcctgagagattcttcccagattcttcgagcacgctatggactcctttagggagctttaaaataaactcatcagcgtaggcacgttttagagcttctaaaacagcctcctcctccatatccttaccacaggtaaggttattccatacagtatcatagaataagaaaggattctgtaatacacaggcgatgtgattccttaaggaccctttgttatattccgtaataggaagagagtcgataagaatctttccttgggagacttcgtagagcctaggaagtaatttaacaagtgttgtttttccagatcctgtaggtcctacaatgcctagagcttcgcctttatgtaaggtaaagcttagatttttgaggatgtgcttatcttcctgatagccgaaggaaacattctcgaatgtgattgtattagaaagtccaaggaactcgatttctctttctttttgactatgaagatcggggtgattcaagacttcataaaatctctccgcagcagcacatcccctcatgatggaggtattttcatccccgaacttcttaatagggtcgtagattaggtagagcaaaccacaaaatacgataagttcttcgggaggaatagcaaatttataaattccgataacgacgacaaaagcaaaaaataaagaagctatggtatgcaggaggggtcgtggaagcaaaccgtaagcagcacttttctcctctaaagcagaaatcttattgttatgctcacaatattttgtgaaggcaaatttttctgtacgaaagacttttactgtcataaccccagcaagaaaatcataaagaacggaggaaaatgaatcctgactcttttgaatacgttttgctaaatttttgatctttctagcgatcacgacaatgggaaggataaagataggaaaggcaacacaaataagaattgaaaacttccatgaaatcgacagacagactcccaatgtcaatatgaaggtaattggggcttgaatgtagttaatcattaaagagtttactgctaaggcaatgcttgcagaatctgtcatgacacgattacttaaattaccgatatcatgatcatggaagaaggtcatggggagttgttgtagggccttaaagtagtcctgacgtaagtctcggcttacccgtatagcaacgacttgcccaaggaaacgttggaaaaataaggtgactgctttaaaaatagcaacgcagattaagaagattgccagtcctcgaaagcggctcacatcgatgtagttacggacaaacttagagagcttgctcgtcagagaggctgtgcttttcccatgttcggcgatgtatgtcgtggcatcagagactgtaagtgtctctgaatccttactaattgcctgccaattctctaaaatatctttctgacttagttctgaaacctttacaagttttccagattccttacgtccaaaaagtaaaaaggcgtcggggcctgttttagcaatcatccctaaagaaaaaatctccatctgagatgaaaaggtaagtcctaaaattgcgagtagagaacagcctaatataacgagatgatttttatgcctcaggaccgctttcagaagtagtttcataaagacctatagagcgaaatttttcgtaccgtttctccaacagctcttctatagctagatcttttaatcgtaaccactcttggatgataaactctcgaacattgctatataccaatgcaggatcgtggtgagctcccccaatgggctctttgataacagtatcgataatgccaaattgttttaagttttctccatgcattttcaacatggaagctgcttcgctatttttcttaggatctttccaaagaatggaggcgcatccttctggggaaattacagaataataggaatgctctaacatagctacagaatcacctacagccatgcccaaagctccacctgaacatccctcaccgataacgacaataatcacgggagtggcaagtcttgagagctcaaaaagatttttggcaattgcccatccttgtcctctctcttcagcagtcaatccaggatatgctcctggggtatcgacaagaaagaccacaggcaagccaaacttttcagcgagttttcctaagcgaagggcttttctgaaaccctcgggacataacataccgaagttcctatgaaggcgtgacgctgtatcgcatcccttttcttggccaataaggacaaaacgctgaccctggatttttacaaagccaccaacaactgcgggatcatctcggaaggtgcgatctccacaaagctcgacaaactcctcacacatcccttcaatatagttgacagtacggggacgcgaagggtggcgacatatttgtacacgctcccaaggagtcaaatccgaatagatcttttcttttaatttatctaaacgcttttccaatttctgaatctctgaagaagataagagagaatttttcttatttttttctttaaattcggctatagccttttcatattcaactacttgtttttcgtgtggaagaagttccattagaatgtgctctcctcgtataaaaagaatcattttaatacaaacaattcttaaacacaattacagacccaaaattaattcatcttcgtaaagaatcttcctttctcagaggtcacttttttttcaaaaattaacatgacgccctcttctttgtaaggaatattaatcaaaaagtctgcattccaaaatttttctttgccttgcaaagcaaaaatttccatatagggacttgcagaaacaatgttgattgcgtcattttccccaagaatcataatgtcgtttccgggacctttataagaatctagggaacaggagcgcaagcgagggccgtcaacaacctgacaattcttccccttacagaaaatagaaaacgtcatggcagaggtggcctcagccaacgcagcgtgcacgcgatattgcttgtcggaaatagtgatcttacagcggatcggcagatgtacataggaatctcgaaggtaggaaaatcccgtatttctgggatgaggctttcctgtagaggtgagaaaagaaatctctgtagtttggtgagatttttggcacacgaactctttagcgattccacaacatccaaaataataacaatcactaatgtctccagagcaaggtccataagcgataacaccgacatcccctgaggaatacgctcccaagctactttgacatcctgaagcggctacaaaagcggatgaagaacgcgttctttgcatccagaaccctagtgcaggatcctcaagactgtattctgggtgaatttgcattcctaattggaagagaaacgattggctaagagttgtcttttcttttaggagtcgagagttctcctggctccagagagagggaaagacgctcccttggtgatcaaagagtgcctgttgaaaatgactcattttagagacgtatgcctgactctcttcataaaactctgcgatctgtaacaggagtaggccaaattccgcatgttctgcaggataaggtaatcctttccaaggaaatcccccacaagaaaacagttctacagcacctgaagggtactgctgtacatttaaaaagcttaagcctaaatcctcgccttcttctaaggccatcaaaagatagacggcccgagcaatatcatgaatttttagtaaaggatggtagcggaaaatcttgagtacagactgccttaatgtcttatcttggcacgcatagataaactgttttacttgtgaatcaaagttcgaattctgggacacttctatacaatgttgtaacctggattgcagccccattatcacgcacaatttgatcagaaaagcattgcaccaaacgataataataacaaaaattagagtcaagcccggtaaaaaaccggtctgactctaacaactgagacaaagaagactacaagaattaagaatgcttattcggagtttctatcaagcgcttcattcttttccctggagtaaactttacagcgcgtctagcaggaatatgaatggggactgctgcattcttaggattacgtcctacctttggttttctttctactacttgcaacacaccaaaatctctaaactcaagcctgtcacctttaaccaaggcgtcggtcattttatctagaaaattctgaatcacggtacgtacgtgattaggatgaattttgtgatcttgtgagatcgtgctgattagtttcttctttgtcatggtagccatattagacaatgcctcctattaaagtgccctaaagtagctcgttgagtaaccgtaaataataaacttttgaagtctaagctcatcatatctattcatcctttggattcaagacattttttaaaaaatgcgcaatcactataaaccatatcgattaatgcgaataactatatttctagaacctagaaaaatcattcccacatcttgagaaaaacttcccctaaattgctagcgtgcatctaacacgtgacttctttaatctaacttggtaaagtgctggtctttgcgtcctcgtagctcagcaggatagagcggttgcctcctaagcagcaggccatgcgttcgaatcgcatcgaggacgattttttgcctttaactcctaaagtactaatttgcttgtatctgtggtttacgtattttagcgatattctgttttggtttctgaaaactaggtccagaaagaaaattatgaactccctcggcgatgcctttcgctacatgcatacgatagcgagcatcttgcagggccgcacgttcacgactattggataaaaacccggtttccaccaaaactgcaggcatagaagtatctctaatcacaacaaagttcgcagttttcaaacctcgagacttcaaaatgccatttttttccatagcagctaaaatgttttttcccagtacttctgacatgcgattcctagtcggagatccgaccttaccattataaaaatatacttcggtgccaaaggctgctgcgtttgaagaatgattacagtggatgctgataaagacatccccctgcccacggttcgacaaagcaacgcgtttccctaagtcaacgtatacatcagaagatcgggttagctgaggtttataacccatccgctttaagtaactttgaaccgtcaaagcaagagacagggtcagggacttctcttcataatgaagttccttacttgccgtgccttgatcttttcccccgtgtccaggatctataaatataacctcactgcgtcgtacacgctgaggaggattcggtgtttgagcaaaaatcgggtgacttcctaacacacataaagcaaaaaacgacagttgcttagacataggaagcgagtacctcacaaacagtctgcttatcatcgaacgcaactgtttggtgtttaaatatttggtaagcttcatgcccttttcccgctattaacactatatctctatctgaggcaatagacagagcatatgtaattgcttgttttctgtcgatttcgatgaaatagttttttgaataaaacccatcacaaatttcattcacaatatcttcaggaggctcgctcctagggttatctgaagttacaacagcaaaaccataacgctctaccacctgggccatcaacttccgtttactgcgatctctatctccaccgcaaccaaaaacaacaatcagtcttcccccctcaggaagtaactcatgcaatcctgttaagacattgtctaaagcatcgggggtgtgtgcataatcaatatatacagggcagggacccataagtacaggatccaaacgacctggaggaggttgacacaagcctatcttttctagcaaatcttcaagatcgcaacgcaaacttgcatgtactgtagagatcgcagcaagtaggttatagacgttgtactttccaataaatgaggaagagcacgcaattttttggtccccgtacaccaaggtatactttgttcccgaggaagaaagttggatatcggtggctcggtagtcagcagcactctctataccataagtgatgaccggtgcctttgcactctcaatacactgagaagcgtagggagagtctgtgttgataacaaccattcccgaagggggcacgagagagaaaagcttggctttcgccgcaacataggtttcaaatgtgccatgaaaatcgagatgatctaaggtaatattagtcagaactgctgtatcaaaattggtataggctactcttccagaggcaagtcctatagaagagacttccataacaacagcgtctctattttgacgtaccatagtggctaaatacttctgtaaaagagcgggtgtaggtgtagtaaacccatctttaatcaccccctctcctaagatatgctctatggttcctaaaagccctgaaggtttttgatagctatccaataaagctttaatcaaacatgtaactgtagttttcccattggttccagtcaccccaatggtatggagcttacttgaagggtattcgtaatactttgcagaaagctcagcctctaattcttcgagattaggagtgatgatctgaacaacggaaagaaacggattgtatagtgaagaagcaatggcaattgctccattagctaaagcatcgacagcaaaatcatttccgtcgtagcgctgtcccttatgggctataaaaatgtcgccaacactcacacaacgggaatcacgtgtcaagttgcgcacttcaagagggcgaactttcccatagattttagcttgaaccccatggagtaactcttttaaatccatttacgctccagggactattgaaaaacaacttttttcataaaaagccctctaggggcatgctctcactctgatttttaaaaaatgcttaaaggatttctttactcgtaggtcgacaaaaaattcaatcaagatagtatacaagcaatcacaaaaaactgtccataaagttcttactcttctctgaaatataaaatttcgctctcctgtttctacgaacagaagcctcctttatcccaaatctaaatccccaaacacacagccttacctcccccttccataaacttcaatagaccgtctcatcaagactttggtctcttatttaggggaagaaagctaaagttatttctatagtttaggacctaccctagccataacataaactactcatagaggataaagaggagacgggctctctgatagagagtctttgctcaacggtaaaagtctatagcaagatggaaatagagatcctcacctcgttcccccttgtttcggagaacgattccattcttcatagagacgctttaatgcagcagcttcttcgtcgcaatttcttagcttcttgtctggaagaatccctaaatagaggagtgtgcggtcagcaaccctagaaaaaatgggtgccgcacaacgcccccccatataatttttcgtgccgtcggctcgcaaaccatattcaggatcatctatggagacgagcatcactaaaggtgggaaatttccctccgagctctctacgggagtaaaacctataaaagaagcaatatgacggcgtttatcatattttccatgaatcatcttttctgtagttcctgttttcccagcactagagtgatgcttaggagaggctcgaaatcccgaacctccgggtaacgttgtaaaacgcatggcacgaacaacttctctagtaatttcttctgaaaagagtcgtgtcttctctttagtaggaagatgatattcctctcctgaagcagagacgatcttttttactaaagtgggccggacggcataacctccgtttgcaaggatagcgtaggcttgaaccatttgtatccctgttgccaaaatattatatcccatagccaaagaatatggagtagataaggaccattccagggaaccattaatatggaaacgatggggagaaggcaccaaaccagaggcctcactgggaagctcgatccctgtttttcttccaaatcccagagctagcaacttctgttggtaccaggccactcctaaagattgtatgatgcggtcagccagctgagctacatagacattcgaagatttctggatagccatgtacatattcaattgagagtttctagaaatatccttaagcggagatccttttcgtccagggaagagtgtcctggtcacatcgataggttcttcaggatcaaaaatctttttctgcgattttaagctagcctcttcgttagcttgtaaagcaatcgccacagtcaaaggtttcatgatcgacccgggttcaaaaacatcgctcacaaaagataccttcgtatgttcgatgcgctctttgttattgaagtattccttataatttgtgggatcgaaaaacggatattgagccagtgcaagaatctctcctgtttgggagttcattagaatgagcctacccccctgggctttagcttctagcacgccccgttcgagttcttcctctgcaatggtctggatcacaggattgatcgtaaggtagatatcagagccatctttaggcagtttgataacacgattcgtatctaaacggttcaaaggagaacgcaacagctttctctctccaacgtccccttccagaatatgattaaagtacgcctccatcccgcctgtgggaaaggcttttcctgttttctcatccttaatttctcttaaggtatggagaacttgtccaaggagcttcccaaaaggatacgagcgttggtagtccgtaataaaaaatagggcgtttgttggtaagcgatgctttgttgcatatcctttccaccaaagggatagccggtcatggacagaaacatctaataaaggatacagcttacaataccgagatttcttatctaactttagggagaggtcgtcgtaggtctgcccctcaataaattggagaatcccttggatgatctcatcacgatgacattcgggaatagctaaaggatctgcacaaaggtgaaattttgtaatatcgacagcgaaaggctgctgaaggtctttgtctcccttacgtactgtcgtgttagcaaaaaaggtgccccttcgaaaaggatcacggacacaaaattcgtgttgcccgagagcttctgcggcccagtggtctccttcacaaatttgaattttataataacgcaatactagaagagcataaagagcaaacactcctagaacaattagagtcgaacgtttacggtagctcataggataaaagactgatactttcttctgagggatattccaaatattggtattcgggaagagctgctatttccatcaaatgatcaggtctttctattttatcaattaaaaaacgtaaagaaatattttgctgctcaagctgacgcaagcgtacagataaacaaggaatttcgaggcgtaatttcgtcagcgagttctgcttattaatatagaaataaaagagacttccacaaaagcatagacagcagcataaacgtaaaaaacgacttttgttcattgggaagctttttcaaaacaccgtagttttgctgatctcgatctaggatttcttcgtacttcttggtaggtaggttggatcactttctttgtgattaccttccccaggccagaagcttccgcctctttaaaaaaccacttcacaggacgatcctcagagctacaaaaagaaataatgacaagccgtccctgaggagccagccaagatatagcagatgttagtaaacttttcaattgtctatcctctccattcacataaacacgtagagcttgaaaaatcaaggtgagtggatgtatttttctatgaaaacgatagtgagggaaaacgccaagaagagcttcttttacatcctggatcgaaagaatttttttatgcttacgaaaatggacaacagctttagctgcagatttccattgtggttcctctccatattcacgaaaaattctccctagttcttcttcttttagggagttcaggacatcgctagcggaaagctcttgcgtttgatccatacgcatatccaactcttctttttccccttgaaagctaaaccctcgggatagagtatccagctgcatagaagagactcctaaatctgcaagaactccgtcataaagacgtggagtgggttggttcgcaagatcttcaaaagaggcgtgggaaaaggagactctatcttgaaaggtctccaaacgtttttctgcaattgccaaagcctgaagatctcgatcggagccatcataacaagttagagagggatacgcctcaagaaaagcatacgcatgtcctccagctcctaaggtgacatctcgaaaagtctgtggaggacgttgagcaaataaagctaaacattcttcaactaatacgggaatatgcgcacgttcggacataagaatttcctaagctcttggcttcaaataaggacaaagatacaggattccatagaaagaagaaagccttcccttatcttaaattctcgctagttcgccactctaaattttttgataggggtgagcttttttcttaagtgccttcgataaggagaaaaggttcaggcttctgatcaagactattgactttttcctagaccgcactatcatctagagatagagacggttttttaaggcctcgccatggtagaaatttttaattatagcacgtctatatatgagcaacatgcttccaataataggatagtcagcgactttcgcaaagaaatccagatggaaggcatctccattcgtgatgttgccaagcatgcgcaaattttggatatgaaccccaagccttcggctttgacgtctcttttacagacaaatcaaaagtcgcactgggcatgtttttcccctccaaataatttttacaaacagcgtttttccacaccctacctggcaccttctttaggatctccagaccaacaagatgaagacatagaaaaaatctcctcatttttaaaagttctcactcgagggaagttttcctatcgcagtcaaattactccctttttgtcttacaaagataaagaagaagaggaagacgaagatcctgaagaagacgatgacgatcctagagtacaacaagggaaagtgctcttaaaagctctagatcttggagtcaagtctacaaatgtgatgatagactatgtgatctctcgtatctttcaatttgttcaaggataatgtatgttggataatgaatggaaagcaatcttaggctggggagatgatgagttagaagaactcagaatctcaggatattcttttctacgccaagggcattattcaaaagcgattcttttttttgaagctctagtgatcttagatcctttaagtatctatgatcatcaaactcttggaggtctttatctccaaattggtgaaaatagtcaggcgcttgctgttttagatcaggcactccgcatgcaaggagatcatctgcctacactcttaaataaaacaaaagctctcttctgtttgggacgaattgaagaagctactgccattgccacctacctttcatcctgtcccataccagcaattgctaatgatgctgaagctctattgatgagttatagtaaagcaaccaaaaaaaatgctgcgttagttcgttaattttttctcctatagaaaacgtatttcgtgattgaagaactccggatttctttagttctttttccatttttattacaaaatttcataattattttttcctgaatttgtggttccttattgcctaacgaaaccaacgatccaatttgccttaaaacctagtaatcggtagagttattttatcggcagagcgtaccgcgtttacctgcggaggaagggtgtataggatccattcctaacaggaacttcacccagggaatgcaggatccaatctgaacgcgaagagtcattgcactcagtgcaatgaatagtcaagatgcaatgagattttctcgccatcactcatgggatgggtcgattgtatttgggaaagctttataaataaagagagcggcatgttaacctgtaacgagtgcactacttgggaacagtttttaaattatgttaagacacgttgctcgaaaacggcttttgaaaattggatttctcctattcaagttcttgaagaaactcaagagaaaattcgcttagaagtccccaacatttttgtacaaaattatcttcttgataactacaaaagagacctctgttcttttgtccccttagatgttcatggagagcctgctttagaatttgtagttgcagaacacaagaaaccttcagcccccgtggcttctcaaaaagaatcaaacgaaggaatttctgaggtctttgaagaaactaaagattttgaattaaagctgaatctctcctatcgctttgataatttcattgaaggtccctcaaatcaatttgtgaagtctgcagctgtaggtattgctgggaaacctggccgctcctacaaccctttattcatccatgggggtgtgggattaggcaaaacgcatttacttcatgccgtaggtcactacgtaagagaacatcataaaaatctacgcatccattgcatcactacagaagcgtttatcaacgatcttgtctaccatctcaaatccaagtctgttgataaaatgaaaaatttttatcgttccctagatttacttcttgttgatgatattcaatttttacagaatcgccaaaattttgaagaagagttttgcaatacctttgagactttgatcaacctgagtaagcaaattgtaattaccagtgataaacctccaagtcagctcaaactttccgagcgtatcattgctagaatggaatggggactggttgctcacgtcggcatccctgatttagaaactcgggttgcgattttacagcacaaggcggagcaaaaaggattgctcattcctaatgaaatggcattttatattgcggatcacatctatggcaatgtccgtcaattggaaggagctatcaacaagctgactgcctattgtcgtcttttcggcaagtctcttacagaaactacagtccgagaaactctaaaagagctcttccgttctccaacaaaacaaaaaatttctgtagaaacgatcttaaaaagtgttgctacagtattccaagtaaagctgaatgatcttaagggaaactcacgctctaaagatcttgtgttagctcggcaaattgctatgtatttagcaaaaactcttattacagattctttagttgcaataggagctgcttttggtaaaactcattcgacagtactttatgcctgtaaaactatagaacataaattacaaaatgacgaaactcttaagcgtcaagtaaatctctgtaaaaatcatattgttggttaatttagggggtgtcccatgttccgtagaacaggaaaaggtccttttgaagatgtgcaaacactttacgaagaagaaacttcttcaccttccagctactcgccatattcaagatccgagcgcccagagacccctccaagtctttttgacaaccctaaagcttcggaagctcgccctttgaatcacaatttaactgaagaatcttctcttcctcaatggtcctcaactccaagaacagaatctctactccctcttgaagaacctgaaactaccttaggagaaggcgtcacctttaaaggagaacttgcttttgaacgtctcctacgtattgacggaacttttgaaggcattttagtctcaaaaggaaaaattattatcggtcctaaaggagtggtaaaggcagatattcagctacaagaagccattattgaaggggttgtagaaggaaatatcacagtatctggaaaagtcgaactccgtggaggcgcaatcattaaaggagacatccaagcgaacacgttgtgtgttgatgagggcgtacgtattcttggttaccttgcaattgcaggaattactgatcattctgagagagaaagagacttatagatactagaggtgatgcactccctccaacgatagtttgcatccatttttgtgataaaggataggccgacaaaaagcagataccttcccctttaggaagtttttctatttgtcttttcttaggaagccacggccacaagggaatgcgtaaaagcttttctagtttagcaacttctactacgattttcctagaaattgtcgatgttatataggcaatacaactcggagtctcatccagtgaagctagctcaaaggcgatactcttagaaaaaaactgcagagcgggtcgcttaccttcacaagcacgagcatataccgagagggccgtttgcgaaggaaggtacaagctgaaagcttgaagttgtgaagagggtgaacactggctacatagacgtgtttcggaagaaccaagataacgaaaacaatgtagacaacgcccttctctatcttctacgagaagtttttccaagcagttggaacaaaagtaggctcctggagcttgacagccataacataactttggaaacagcaacgaaaaaagtaccatctatttttgaatcatgaaaatttttattcctaaaattttaagcagtttgctacgtttttgaacgtgtagaagcttcaacttttctctcaatcacaatgctcaaaaaattcataaattctctttggaaactatgtcaacaagacaagtatcagcgctttactcccattgtcgatgcgatagatacattttgttacgaacctattgaaaccccttccaagcctcctttcatccgcgattctgtagatgttaagcgttggatgatgcttgttgttatcgctttgtttcccgcgacctttgttgcgatctggaattcaggacttcaatctatcgtttatagctcaggcaatcctgtgctgatggagcaattcttacatatttctggatttggtagttatttatcctttgtttacaaagagatccatatagttcctatcctttgggaaggacttaagatctttattcctctacttacgattagctatgttgtcgggggtacttgtgaggtcctatttgctgtagttcgtgggcataaaatcgcagaaggactgctagtaaccggaatcctctatccccttactctccctccgacaattccttactggatggcagccttagggatcgcctttggtattgttgtcagtaaagagctcttcggaggcacagggatgaacatcctcaatcctgctctatcaggaagggcattcttattttttacgtttccagcaaagatgagtggtgacgtttgggtaggaagcaaccccggagtgattaaagatagcctcatgaagatgaactcctcgacaggaaaagtactcattgatggattttcacagtctacctgcctacaaactctaaattcgacacctccctctgtaaagcgtctgcatgtcgatgcgattgctgcaaatatgcttcacattcctcacgtccctactcaagatgtcattcactcacaattttctctttggacagagacgcatcctggttgggttttagataatctcactcttacacaacttcaaacgtttgttacagctcctgttgctgagggaggattggggctgcttcccacacagttcgattctgcctatgctattaccgatgtgatctatgggattgggaagttctcagctgggaatctcttttggggaaacattataggttctctgggggagacctccactttcgcctgtctgttgggtgcaatattccttattgttacaggcattgcctcttggagaaccatggcagcctttgggataggagcctttctcacaggctggctctttaagtttatcagcgtactcatcgtgggacaaaacggagcttgggcacctgctcgattcttcattcccgcctatcggcagcttttcctcggaggacttgcttttggtttagtctttatggctacggatcccgtatcatcgccgactatgaaattagggaaatggatttacggattctttataggatttatgactattgtgattcgtcttatcaatcctgcgtatcctgagggagtgatgttagcgatccttctgggcaatgtatttgcccctcttatcgactattttgctgttagaaagtatagaaaaaggggagtctagaatatgtctaaaggctcttcaaaacataccgtccgcataaaccaaacctggtacatcgtttcctttatcctgggcctcagcttatttgcaggagtgctgttatccacaatctactatgtgctctccccaatacaggaacaagctgctactttcgatcgcaataagcaaatgcttttagctgctcatattttagattttaaaggaagatttcaaattcaggaaaaaaaagagtgggtgcctgcgactttcgataaaaaaacacaacttcttgaagttgctacaaaaaaagtctctgaggtttcctatcctgaattagagctgtatgccgagcgctttgtccgtcctctacttacagatgcccaaggcaaggtattttcttttgaagaaaaaaatctgaatcccattgaattttttgagaaatatcaagaaagccctccgtgtcagcaatcccccctccccttttatgtcattttagagaatacctctcgcacagaaaatatgtcaggagccgacgttgcgaaagacctttctacagttcaagctttgatcttccctatatcaggattcggcctttggggccccatccatggctatctaggagtgaaaaacgacggtgacactgtattgggaaccgcatggtaccaacaaggagaaactccaggtttaggagcaaatattacaaatcccgaatggcaagagcaattctatgggaagaaaatcttcctacaagattcttctggaactacaaattttgcaacaacagacctagggcttgaggtagttaaaggttccgtgcgtactactttgggagattctccaaaagctctttctgctattgatgggatttctggagccaccttaacatgcaacggtgtcactgaagcttatgtacaatctctggcttgctatcgtcagctccttataaatttttctaatttaacccatgaaaagaaaacaggcgaatgacaagtaaaaagtcctataaaagctatttctttgatcctctatggagcaacaaccaaattctcattgcgattttggggatttgctcggctctggcagtgacaacaacagtacaaacggcaattactatgggaattgctgtcagcattgttacaggatgctcgtctttctttgtttccttattacgtaagttcactcctgacagtgtgagaatgattactcagctaattatcattagcttgtttgtgattgttatcgaccagtttttaaaagcttttttctttgatatttccaaaacactttctgtttttgtgggtcttatcatcaccaattgcatcgtgatgggaaggtctgaaagtctagctaggcatgtgactcctattccagcgttcttagatgggtttgcctctggcttaggatacggctgggtcttacttgtcattggagtcatcagagaactctttggttttggaactcttatggggtttcgcatcatccctcaatttgtttatgcttccgaaacccaccccgatggataccaaaatttaagtcttatggtgctagcaccgtcggcttttttcctacttggtattatgatttggcttgttaacattcgagactctaaaaagagaaaaaggtagtttatgtggttaggtgcgtatacttggcttaatgtctttggtattcttctacaagcagcctttattcagaatatccttcttgcgaatttcttggggatgtgtagttaccttgcttgctctactagggtttctacagccaatggcttggggatgtccgtagcccttgttctcactgtaacagggagcatcaactggtttgtccatgctttcatcacgggccctaaagctctaacttggatctctccatctttagcttctgtaaacctaggttttctggagctgattattttcatcgtggtgattgcggcattcacgcaaatcttagagcttcttttagaaaaggtctccaggaatctatatctctccttagggatcttccttcccttgattgctgtgaactgcgcgatcctagggggtgtgctcttcggaatcacacgtagttatccttttattcctatgatgatcttctctttaggagcgggatgtgggtggtggctcgctattgttattttagccactatcaaagaaaaactcgcctactctgatattcccaaaaacctccagggaatggggatctccttcattacaacaggcctcattgctatggcttttatgagcttaacaggtattgatatttctaaaccttcagcaaagattcaaagagctcctctagagactgaagttgttgaaaacacgaccaatccactaaaagaatcttcgtccaaacaccagccaagtatttctaaagcacgaacgcagcgtcgctctctctaggaactttcctagagtcgagtttctagtgaacttttgtacacagagatgcttctaaacaatttcaattcgagatatggaaggcggctttttgcaagctgtggcgattttacttgcgatacaataaacaacgatcgtcagtaaaacacaaatagcaagagctatacctatatagagagcgcagagtctcagttgagaaccttcacaagaaaacaaagtcacggcgaaagctacagctaacgaagtgaggagaatagcaagcactttcgcaaaaatccgataagataaagaattctccgaatggagaaggacactagaataccgttttaggaaggtcagagtatcgggattttgtcgagaacggggaacgtacttaggtaatgtagtcatgatttttcaatcaataaaatgtccaactcagctttcatgcgctaccttagttttttctaaggcattggaaatcttataacgccaacacgcacaaactaacatagataaggtaatgcaactcgcagcaatccagatcgagagctgtagaggtgccgatcccgttaaaaataggccacaggctaccaaagaaatcgctatcaatgaaaggaccatgatggctatagtaagcttcttcacacgagataccccggaagataatgcggacaattcttcagaagatagttgcacatgatcttgtaggacatgaggggctaccggactagctggatccatagaataattctgatgtattttttaaaccttagacataaattttaaatgttttagccttaaaaaaatacctcttatcttctgaaaaaaatgagtatatctaataaaaaatttactcttcatccatcaaagaaagattagaaggatcccagtcctggtctagtcggactacagccaaccatccctcaccttctggagcttcgttaatcttctgaggattatccactaaatcaaggttgatatcgataacctctcctgatacaggacttaacacctctatagcagatttagaagattccagaatgactaaaacctcaccttctttacatagactccctactgaaggtaaatccacatggagaatggctcctaaatttttctgcattttttctgttaacccgaggcgcaccaccctctcatggacgggcaaaatccaaacatgataatcagaataccacatcaccttacgactccctgttctataaagcgttccatataggatcctaaaagttcttcatctagctgacttttagctaaaaatagtttatccacgctagcaggacgatcatacagtaaatgagagaggcattgataataacagggcccttcgttaggactcatgaatacagaagaatagtctcctaccttcatagagaaaatcctatcaaactcttggggcagctccttgtctcctcgggaaaaagtcttcaatgagcgatctaagctccaagagaaagacccctcgagatgccttcccaatctgtggttttccactaccttccaaagacgtcgttgccataggctagcgccttcttctcctggataccgtgtacgcaacgcagattctagacgctccatgtcaacaagatgaccatgagaagtaagtaactgtgaggccaaatctctctttaaaacctcacgataaggaagcacttcttctttttcaaaagaactattaacaataatagtataataggtctctgcatcctggctatataaatctaaaacctcgttttcaagcaacactttggctaattgctgaccgtcggatattcctggtagagcactattcttccctgcagataagagaacttcttggctctgcttaggaacttgctgtagcgattgcagaattctctcagggcgggcccttaagatttccttgcgtgtgaaaagagaaattttatctcgcagcgcaggcttaagatgttggaagtctttatacgactgacacgtctcaacgtcaggaaactgctggagaatctcctggaagtgctcagaattttgttgccagtgcagcacttcaaccataggtacagtagctgctaagtcttgcaaagcgactctcttatagtctatagaaaaccgtctgcctactaaccgaggctctttagcttttatggtcgctataggaaggatctcattaggaacatccaaactatccgatttaggtaaactcactaactttaaatagacttcgaaagcttttaactcttgttttgttttaaagctatactccttagggagtctaaagaactctacttgtatggaatcttttccttgaacgaaaaatgtagttagaggttggaagtcaaaagaaacgcctccctgcaataggagaagagctcttttgcacaacaatatgtctcgatacatattgaaaaattcggactcagagatctctaaaaactgaaaatacgagtttacaaattcttcaaatcctaaggaaaattccttattcttactgatcttagtataggcatgcttcgccttatcataaaagtcgtcacgagcttcttgttttgagggcctgggaagtacttttttctgctcgtcaataaagcggatcaagagctcaacagcagcagaaaggtaggcatccccaaaccagtcttgaatcgtctggtagccaaataaccgcaagtctttcccgcgagataaggcttcatctgggggaagagcaaacatttgcctgcggtactccaacatttgtcgaagcacataatgagggaaccttctctcttctaaaaagagcttggctctagcaagaaatccttcttttgatatggggttctcgatttgttgaaagaccttcaggatctctaaaagctggggagctgaagatttccaaacttcttcagaggaaataaaaggagcgtcaaaacgacgatacggctggtaagctttctccttactaaaaattttctctcccggatggtacacttttaaaaagagtttttctcccacccttgtcgttagaaaataatcagtaagtagcccctcattgataaaattccaagctctagggttccctgtaaatggatacgcttcgtgagcaaagaacttcttcatagccatgaaatctttctctacataccgcttccctgaagcggtagtaaaaacagtccgacgtgaggtggactctgcagaaccttttctagagaatcgtccccaacccactccaataccagaaacacaaactacagcaatgacaatgccgataaattttttttgatgcttatagaagaacgataacaaggtccaccctctacccaaacaataaaagcgtagtgtaaacgatagcagagaaaaaaaccaggcaggatccctgcagagcctgcagaagagatcctgttggtagattcgcacccagggacgctaggctggcatataggtcagctgcaaatgtcccaaagtgtggtgtacggaatggaaataccaagagaaaatgtcgccatgacttacaggaatcgacaatccgatatctttattgaagactttgttagcttttgcagcgacttctggagattcgataactacaatactttcgtaatcaaaggcatcacttttctttccaaaattataacttccgatcacaaaaatttcatcatcgataatcatacacttcttgtgcaactgcgtttcccaaatagcaaactcataaatagaaacccgctcataaggttttagcttttcgcaaaaccattttttccaaagaggataccgtttcccatagagcaaggcgaaatagttaatacggtttccccaagcatagggtcctgtaattgcaggacttaattcatgacagccgttcgtaattaaactcagatgaacaccgtgattatgagaaacgtcgacaagagcatttaaaagctcgtccttagggatgaaatacatgtgagcaagcttcacagaagatctagctccctggataagtttcaaatattcttgagtcacaggattgggttgcttatcgtggggaccacctaaaactatcctgatcttggaagagtcgacaagaacaagatcttcatgtttgtcaaatccaggaaatactgtctcctcggcttgttctaaagtcagtggaggacaggcgcctgcaaactgttcaggattatcaatgaaccacatatgatgtgcatagtagtcccacatagcaaattgcttatgatattcttctctgagctgcaaaccgaatgctgtagaacgcaacatgatatcctgatcacgaaatgctaggggccgacgcactccactgacaaataaacgtgggttatccactttctcaggaacctcatcccctggagtgcacataaactcttcaaaattggtaccacctaaaatacaatatttcccatcgatgatagaaagtttgatatgcatttcaatgacattaggagcgaggatgcttgttgagggtgggcaccctgtaaaaacgtagaaaaaccggttgggatgacgttctttgagagctttgagtaatttttggtcttcagcatcggtaaacgtgggttggataatgatatagctacagagctctggaaccagatccatacgagcctcgaggtgatctaccatctctttaagcgttcggcctcctgtcatgcagggacacagttctacataaaaatttgcatgatctatgcaatccaatatctgttgaaaggcctctacactattgtcataaacaagaactccaaccttctccttgtctgaagctacgattgtctttgctgaaacagaattaggaaccagcaaaataaaaaatattccaagagctgccaagcgaaaacgcaaccgactcatcataacccctcaccacaaaacaatttaataaacgcctctttgacttgctgacgcgcctcctgcagcacttcatcagcagcttccaaacctaaagggaaaaacgcgtgaatctggatttgttcaataatttcttcaagaacctcgggttttaaaaatctctggtaaaactcagaagaacttcccgataagaataaggatccttgatgtaaaaatccctgttgcaccttgcgttgggcagcgccccctatcttcttgtccccaaaaagaacgtcatacttcgaagtttttgccatacaaaaatttcctgaatctctggaagaagagttttcgtcttctggagctaacattccctggatccgaaatactttctctagaaccttcgctacaaaagagtttacagtatggtagttctcaagtaccgaagaagaataggaaggatgtgtcgcagacataagaacagaaaaagcataatctcccttatggaagacaaatccccctcccgtaggccgcactgcggcgtccaatcctagatccgcatagttggaaagtaaaaatttttctggacgcataaagtgaccgtacgtcagagaacaaggattctcccactcataaaggtgtaaaatgagctccccatcttgcagagattctaataaatctctgtccttagccatgtgggaggccgctgaagattttcctgaatctacgatacgaactttcatataacaaacataaaactaattaagactgtttcaaaagaagctgaactattgtatcatatacaaaaggtttgtgcataactttcccttaaactcagaggaattttaccaaatttgctggtttagagcgaagagttgcatcattattttaaatttcgtatatgcttaaggaaagttctacccctgtcttttaggtttttatgtttgagaagttcactaatagagcaaaacaagtcattaaactggcgaaaaaggaggctcagcgtttaaatcataactacctgggtactgagcacatcctgcttggtcttctcaaacttggtcaaggggtagctgttaatgtattacgcaacctcggtatagattttgatacggcacggcaagaggtggaacgcctgattggttatggtccagaaattcaagtctacggagaccctgcccttacaggaagagtaaaaaaatcttttgaatcagcaaatgaagaggccagccttttagagcacaattatgtcgggacggagcatttactcttagggatcctacatcaatcagatagtgtcgctcttcaggtattagaaaacttacatatcgatccaagagaggttcgtaaggaaattcttagagaattagagaccttcaatctacaacttcctccttcgtcgtcgtcttcttcctcatcctctcgaagcaacccttcatcttcaaaatctcctttaggtcatagcttaggttctgacaaaaacgaaaagctttctgctctgaaagcatatggttatgatttaacggagatggtccgagagtctaagctcgatcctgtcattggtcgttcttcagaagtcgaacggttgattttgattctttgccgaagaagaaaaaacaatcctgtacttattggagaagctggagttggtaagactgcaattgttgagggtctggctcaaaaaatcattctgaatgaggttcctgatgccttacggaaaaagcgactgattactctagatctagcattaatgattgctggaacaaaatatcgagggcaatttgaggaacggatcaaagctgtcatggatgaagttcgcaagcatggaaacatcttgctcttcattgacgagctccacacgattgtaggagcaggagcagctgaaggtgctatcgatgcttcaaacattttaaaacctgcgttagcgcgaggtgaaattcagtgtattggagcaactacgatagatgagtatcgcaagcacatagaaaaagacgcagctttagaacgtcgtttccaaaaaatcgtggttcaccctcctagtgtagatgagactattgagattttacgtggcctcaagaaaaagtatgaagaacatcacaatgtcttcattactgaagaagctttaaaagcagctgcgactctttctgatcaatatgttcatggacgtttcctccctgataaagcaatagatcttttagatgaagctggggctcgtgtccgtgtgaatacaatgggtcagcctacagatttaatgaagctagaggctgaaatcgaaaatacaaaattggccaaagagcaggccattggaactcaagaatacgaaaaagctgcaggtttacgtgatgaagagaaaaaacttcgcgaacgtctgcaaagtatgaaacaggaatgggaaaatcataaagaagagcaccaagttcctgtagatgaagaagcagtcgctcaggtagtttctctacaaacaggaattccctcagcaaggctcacagaagctgaaagtgagaagcttctgaagttagaagacacgttaagaagaaaagtcattggtcaaaatgatgccgttaccagcatttgccgtgccatccgacgttctcgaacagggatcaaagatcctaaccgacctacgggctccttcctattccttgggcctaccggtgtagggaaaagcctgctcgcccaacaaattgctatagagatgttcggtggtgaagacgctctgattcaggtagacatgtcagagtacatggagaaatttgctgctaccaagatgatgggatcacctccaggatatgtaggtcatgaagaagggggccaccttacggaacaggtacgtcgccgtccttactgcgttgttctctttgatgagatagaaaaggcacacccagacattatggacctgatgttgcaaattttagagcaaggacgtcttactgattcttttggtcgcaaagtggatttccgtcatgccattattatcatgacctccaatttgggagctgatctcattcgtaaaagcggagaaattggttttggcttgaagtcccatatggactataaggtcatccaagagaaaatcgaacatgctatgaagaaacacttaaagcctgagttcattaaccgtttggatgaaagtgtgattttccgtcccctcgagaaagaatctctatcggagatcatccatttagagatcaacaaactggactcgagactgaaaaactaccaaatggctttgaacatcccagactctgtgatttccttcctagtaacgaaggggcattctccagaaatgggagcacgtcctctacgccgtgtcattgagcagtaccttgaagatcctctagcggagctcttgcttaaagagtcctgccgtcaagaagctcgcaagctacgagcaaccttggttgaaaatcgcgttgcctttgaaagggaagaagaggagcaggaagctgctctccctagccctcacttggaatcataggaacgtcgataactccactaccaaggcaggtatctccttgataaaacgctattgtttgtcctggagttaccgccttgacgggttgtgaaaatcgcaccttgacctcgtcacctgagctataatctatcgtgcaagcttcatcaggagaacggtagcggactttagcgctacagtgacatccggatttaggaggggtaaaccaattgagctctctagctgttaattcccgtaggtagagctggggatggtcttcccccctcacaatataaatgctattttcctctatattttttcccacaacataacagggtttctcggatcctccaagatcaagtcctcgccgctgccctatagtataatagtgagctccctgatgttgccctacaatttccttggtatcccaatcgataacgttgcctgttttattgggaagaaacttctctaggaactctttaaaagggcgcttccctataaagcaaatgcctgtactatcttttttttctgctgtgggaagagctgcttgagctgcaatcgcacgaacttcagtcttattcatttccccaagaggaaagagcacattgtgaagagcacttttaggagttcctgataaaaaatagctctgatctttttgaggatcgcaacctctaaggagttgggtttcttggagctcggtatttaatcggcagtagtgccctgtagcgaggtaatctccgccaagttcctggactttcttttgtagaaggtcaaatttgatttctcggttacaaagaatgtcggggttaggagtgtagcctaaagagtattccttgaggaaacgagcgaacactctttctctatattctttagcaaaagatacggtgtaataagggatatcgagctgaagacataccctctcgacatcttcataatctttagtagacgagcaaaggccgccttcgctatcctcttcccaattcttcatgaagaggccaataaccttataattggtaaattttttgaataaataggcaacgacagaagaatccacgcctcctgacattgctacaattacagtttgttgcataatttctcttacttgtctcctcataggaagggtaaggttttaaaaatttgaataactaagaggcatgactcgcttactaattgactaaaaataccatttttcttaaattatttcctcaaataatagagttctctttgtgtctagtactttaaacggggtatttccctcatcccttccggaagagtctgctgatttattcattacgaataaggagatcgtagctttgggggagaagggcaatgtttttctcacccactccattcctatgcatattgctgcgattacgatcttagtgattgtagctcttgctggaatcgctattatctgtttgggttgctatagccaaagcattctgttgattgccgttggcattgttcttactattttgactcttctctgcctacaagccttggtaggatttattaaattcatccggcagctccctcagcagctccatacgacagtacaatttatcagggagaagattcgacctgaatcctctctacagcttgtaaccaatgcacagagaaaaaccactcaagatacgctaaagttatacgaagaactctgcgacctctcacaaaaagagttcaaactgcaatcaactctttatcaaaaacgttttgagctttctcacaagaatgaaaagacaaatcaaaactagttagcaacgattcgaggaaacaacatggcaacttccgtagccccatcaccagtccccgagagcagccctctctctcatgctacagaagttctcaatcttcctaatgcttatattacgcagcctcatccgattccagcggctccttgggagacctttcgctccaaactttccacaaagcatacgctctgttttgccttaacactactgttaaccttagggggaacgatctcagcaggttacgcaggatatactggaaactggatcatctgtggcatcggcttgggaattatcgtactcacactgattcttgctcttcttctagcaatccctcttaaaaataagcagacaggaacaaaactgattgatgagatatctcaagacatttcctctataggatcaggatttgttcagagatacgggttgatgttctctacaattaaaagcgtgcatcttccagagctgacaacacaaaatcaagaaaaaacaagaattttaaatgaaattgaagcgaaaaaggaatcgatccaaaatcttgagcttaaaattactgagtgccaaaacaagttagcacagaaacagccgaaacggaaatcatctcagaaatcatttatgcgtagtattaagcacctctccaagaaccctgtaattttgttcgattgctgattagaaaaattctagtcctttcatccccctaaatctagggaaatcttcttgaaagtccctcctgagtaggaaaattattagatagtaatttaaaaattacgtatattccatttcaatctctagtaacgttggagaatcttacagaacatgttcaaactgctcttccacatcgctgcatttgcgggacacgtactctcgactcctatttttattgttcaagatgcttgtggaattgatgaagaagcatgtaaaaatcctcctccacgtcctttctctgctcaggtacaatacctaaaggtgaacgatgctaaatttaaaaagctgcctcatcaaactataggctatcgtcaatacgatggaacgtttctctgcacacttccgattacagagcattctgggctactgttttctactggctatataggtgcggatattcaatggaaaagctcacttcctatttcggagacagatcctaatggacttgggtgggcgactttccaagatacttctttttataactatgttctcctctctttaggagcttatacactctccttaaaaaattggcagtggtctatcattctttctgggcttgtggatcctaaaaatattgagatgggttatggactctatcaaggagttctttctggaaaataccaggccactgagaagctttctgctatttttggcgtcattaatgaaacaggcctccatcaagagaaggcttggcctttagtaggtgttagttacaaggctaccgaccaactaactctcaattgcatctatcctgtgaatttttctattgattaccgctcgacatctgtctgtaacttagggcttgcttaccgccttacaagattccgaaaaaaacttcacaaaaatcacctaatttcttctcgcggcatctttgaatatcaaggacgtgaaatcgaagctaacgtgaagctcaccccttggccgggaagttttattaagggattttacggttggtctattgggaatgatatctcgatagctgatgatcacaacaataataaaacgtcccatacttttaaaacctccgcatttttcggtggttccgctgtaatgaacttctaatttccagtttccagaaagatttttttacaggcccatacaaaaacttcaggagattttgtctacttgtgtctctcattttcctgccttttcaggaatttcgattgtctaaaaaccactatcctcttagaatttttacataatttttcataaaatattctctttcaaacggatatgggattcaaaaatatctgcaaacaaggctctcagctatacctgaatggcatttttccggaacgaatactagctcgaaaattaaaaaactgtgcgaagagctatcccagaactgctcttaccatagaagtactggtatcctcggtcttaggagctcttaaggttatcctgatcccttgcgcttctacatatgctgccttgaccctacccctacgggctctctttaacgctataaaaacaaaaagctgccaacatcttgcttcgtatgctatggcttggctcctccacattcttacgattgctgtgattatcggtctggtctttagtctggtctttatcccccctccagttgtctttatctccttggggcttctcatgtctgtaactactagcgttaccctcttccaagtgcataaaaatcttttccccccgtatgagcctccaccctcacgacctcacacgccccctccatttgctgatgagtatgtccctctcataagcgagtcttatttcgactaaaagttccaaataaaaataacttaaagttttagttaaaaatctgttaagattttaacaaataaactttatttaataaaaaagttaagactcagaagaaaagagaactaactaaatcctattaaatcttataatagtatgaaatatatcctatgaatgaaaattcatgggcctaatgataattacagtaagttgatagtatgagccaaccccctataaaccctttaggtcaacctcaagttcctgcagcagcatccccatcagggcagccaagcgtggtaaaacgtttaaaaacgtcatccacagggttattcaaaagatttattactattcctgataaatatcctaaaatgcgctatgtctatgacacaggcattattgcccttgcggcaattgcgatcctttcgattctcctgactgcttcaggaaacagccttatgctttatgctctcgctccggcacttgccctgggagctttgggagttactctacttatttctgatattctggacagtccgaaggccaagaaaatcggtgaggcaatcactgctatcgtcgttcctatcattgtattagcgattgctgcgggtcttattgcaggggctttcgttgcctctagtgggacgatgttagtctttgccaaccctatgtttgtcatgggattgattacggtggggctatacttcatgtccttgaataagctcaccttagattatttccgtagggaacacctcttgaggatggaaaagaaaacccaagagaccgcggagcctattctagtgactccatccgccgacgatgcaaaaaaaatcgcagtggaaaagaaaaaagatctttctgcatctgcccgcatggaggaacacgaagcttcacaacgccaagatgcccgtcatcgtaggatcggtcgggaggctcaaggatctttcttctattcgtcacgaaatcctgagcatagacgctccttcggcagcctctcacgttttaaaacaaaaccctcagatgcggcttctacacgacccgcatctataagtcctccatttaaggacgattttcagccttatcacttcaaagatttaagaagcagttcattcggtagtggagcgagcagtgcgtttacacccataatgcctgcaagttcccgctctcctaatttctccacggggacggttctacaccctgagccggtctaccctaagggaggaaaagaaccctcaattcctcgagtttcttcatcttcccgccgttcccctcgtgatcgccaagataaacagcagcaacagcaaaatcaagatgaagaacagaaacagcaatctaagaagaaaagcgggaaatcgaatcaatctcttaaaactccgcctccagacggaaaaagcacggctaacctcagcccctccaatccattctctgacggttatgacgaaagagaaaaacggaaacacagaaagaacaaataaggatccgtggtttagataaccatcttccttactctctccttctaaaattcaagaaggtctaaaagcaaaaccgcttgtacaccttctcccctacccttaagcatttcccttatgttttaagggactcttaaatatagaaaaataccttaaatgcttctctcccaagattgaaacttctataactgagagtcttctccagagcatttacttgatttatttaactgtattctctattggtgcaccatgctcctaaagccacatgctatgggagtatttttgataaaaagcttttccccaaagacacatgaaatattctttaccttggctacttacctcttcggctttagttttctccctacatccactaatggctgctaacacggatctctcatcatccgataactatgaaaatggtagtagtggtagcgcagcattcactgccaaggaaacttcggatgcttcaggaactacctacactctcactagcgatgtttctattacgaatgtatctgcaattactcctgcagataaaagctgttttacaaacacaggaggagcattgagttttgttggagctgatcactcattggttctgcaaaccatagcgcttacgcatgatggtgctgcaattaacaataccaacacagctctttctttctcaggattctcgtcactcttaatcgactcagctccagcaacaggaacttcgggcggcaagggtgctatttgtgtgacaaatacagagggaggtactgcgacttttactgacaatgccagtgtcaccctccaaaaaaatacttcagaaaaagatggagctgcagtttctgcctacagcatcgatcttgctaagactacgacagcagctctcttagatcaaaatactagcacaaaaaatggcggggccctctgtagtacagcaaacactacagtccaaggaaactcaggaacggtgaccttctcctcaaatactgctacagataaaggtggggggatctactcaaaagaaaaggatagcacgctagatgccaatacaggagtcgttaccttcaaatctaatactgcaaagacggggggtgcttggagctctgatgacaatcttgctcttaccggcaacactcaagtactttttcaggaaaataaaacaaccggctcagcagcacaggcaaataacccggaaggttgtggtggggcaatctgttgttatcttgctacagcaacagacaaaactggattagccatttctcagaatcaagaaatgagcttcactagtaatacaacaactgcgaatggtggagcgatctacgctactaaatgtactctggatggaaacacaactcttaccttcgatcagaatactgcgacagcaggatgtggcggagctatctatacagaaactgaagatttttctcttaagggaagtacgggaaccgtgaccttcagcacaaatacagcaaagacaggcggcgccttatattctaaaggaaacagctcgctgactggaaataccaacctgctcttttcagggaacaaagctacgggcccgagtaattcttcagcaaatcaagagggttgcggtggggcaatcctagcctttattgattcaggatccgtaagcgataaaacaggactatcgattgcaaacaaccaagaagtcagcctcactagtaatgctgcaacagtaagtggtggtgcgatctatgctaccaaatgtactctaactggaaacggctccctgacctttgacggcaatactgctggaacttcaggaggggcgatctatacagaaactgaagattttactcttacaggaagtacaggaaccgtgaccttcagcacaaatacagcaaagacaggcggcgccttatattctaaaggcaacaactctctgtctggtaataccaacctgctcttttcagggaacaaagctacgggcccgagtaattcttcagcaaatcaagagggttgcggtggggcaatcctatcgtttcttgagtcagcatctgtaagtactaaaaaaggactctggattgaagataacgaaaacgtgagtctctctggtaatactgcaacagtaagtggcggtgcgatctatgcgaccaagtgtgctctgcatggaaacacgactcttacctttgatggcaatactgccgaaactgcaggaggagcgatctatacagaaaccgaagattttactcttacgggaagtacgggaaccgtgaccttcagcacaaatacagcaaagacagcaggggctctacatactaaaggaaatacttcctttaccaaaaataaggctcttgtattttctggaaattcagcaacagcaacagcaacaacaactacagatcaagaaggttgtggtggagcgatcctctgtaatatctcagagtctgacatagctacaaaaagcttaactcttactgaaaatgagagtttaagtttcattaacaatacggcaaaaagaagtggtggtggtatttatgctcctaagtgtgtaatctcaggcagtgaatccataaactttgatggcaatactgctgaaacttcgggaggagcgatttattcgaaaaacctttcgattacagctaacggtcctgtctcctttaccaataattctggaggcaagggaggcgccatttatatagccgatagcggagaactttccttagaggctattgatggggatattactttctcagggaaccgagcgactgagggaacttcaactcccaactcgatccatttaggtgcaggggctaagatcactaagcttgcagcagctcctggtcatacgatttatttttatgatcctattacgatggaagctcctgcatctggaggaacaatagaggagttagtcatcaatcctgttgtcaaagctattgttcctcctccccaaccaaaaaatggtcctatagcttcagtgcctgtagtccctgtagcacctgcaaacccaaacacgggaactatagtattttcttctggaaaactccccagtcaagatgcctcgattcctgcaaatactaccaccatactgaaccagaagatcaacttagcaggaggaaatgtcgttttaaaagaaggagccaccctacaagtatattccttcacacagcagcctgattctacagtattcatggatgcaggaacgaccttagagaccacgacaactaacaatacagatggcagcatcgatctaaagaatctctctgtaaatctggatgctttagatggcaagcgtatgataacgattgccgtaaacagcacaagtgggggattaaaaatctcaggggatctgaaattccataacaatgaaggaagtttctatgacaatcctgggttgaaagcaaacttaaatcttcctttcttagatctttcttctacttcaggaactgtaaatttagacgacttcaatccgattccttctagcatggctgctccggattatgggtatcaagggagttggactctggttcctaaagtaggagctggagggaaggtgactttggtcgcggaatggcaagcgttaggatacactcctaaaccagagcttcgtgcgactttagttcctaatagcctttggaatgcttatgtaaacatccattctatacagcaggagatcgccactgcgatgtcggacgctccctcacatccagggatttggattggaggtattggcaacgccttccatcaagacaagcaaaaggaaaatgcaggattccgtttgatttccagaggttatattgttggtggcagcatgaccacccctcaagaatatacctttgctgttgcattcagccaactctttggcaaatctaaggattacgtagtctcggatattaaatctcaagtctatgcaggatctctctgtgctcagagctcttatgtcattcccctgcatagctcattacgtcgccacgtcctctctaaggtccttccagagctcccaggagaaactccccttgttctccatggtcaagtttcctatggaagaaaccaccataatatgacgacaaagcttgcgaacaacacacaagggaaatcagactgggacagccatagcttcgctgttgaagtcggtggttctcttcctgtagatctaaactacagataccttaccagctactctccctatgtgaaactccaagttgtgagtgtaaatcaaaaaggattccaagaggttgctgctgatccacgtatctttgacgctagccatctggtcaacgtgtctatccctatgggactcaccttcaaacacgaatcagcaaagccccccagtgctttgcttcttactttaggttacgctgtagatgcttaccgggatcaccctcactgcctgacctccttaacaaatggcacctcgtggtctacgtttgctacaaacttatcacgacaagctttctttgctgaggcttctggacatctgaagttacttcatggtcttgactgcttcgcttctggaagttgtgaactgcgcagctcctcaagaagctataatgcaaactgtggaactcgttattctttctaagattctccgagaatcttagaaaaacatactttttataaagatgaatacgttattgagatcgcactgtagggtatcagagggggagggcatcccctcttcatcaaagagattcttaggatccgtatgaagagaagtaaaagatccgccatccttggggttctgattctccgcatcaatcaattccttgcgtttcccttgatttctttttttctttacagtatttgctaatttaatttccttgtttcaaaaaagtgcttacaaatgaagtcctctgtctcttggttgttcttttcttcaatcccgctcttttcatcgctctctatagtcgcggcagaggtgaccttagatagcagcaataatagctatgatggatctaacggaactaccttcacggtcttttccactacggacgctgctgcaggaactacctattccttactttccgacgtatcctttcaaaatgcaggggctttaggaattcccttagcctcaggatgcttcctagaagcgggcggcgatcttactttccaaggaaatcaacatgcactgaagtttgcatttatcaatgcgggctctagcgctggaactgtagccagtacctcagcagcagataagaatcttctctttaatgatttttctagactctctattatctcttgtccctctcttcttctctctcctactggacaatgtgctttaaaatctgtggggaatctatctctaactggcaattcccaaattatatttactcagaacttctcgtcagataacggcggtgttatcaatacgaaaaacttcttattatcagggacatctcagtttgcgagcttttcgagaaaccaagccttcacagggaagcaaggcggtgtagtttacgctacaggaactataactatcgagaacagccctgggatagtttccttctctcaaaacctagcgaaaggatctggcggtgctctgtacagcactgacaactgttcgattacagataactttcaagtgatctttgacggcaatagtgcttgggaagccgctcaagctcagggcggggctatttgttgcactacgacagataaaacagtgactcttactgggaacaaaaacctctctttcacaaataatacagcattgacatatggcggagccatctctggactcaaggtcagtatttccgctggaggtcctactctatttcaaagtaatatctcaggaagtagcgccggtcagggaggaggaggagcgatcaatatagcatctgctggggaactcgctctctctgctacttctggagatattaccttcaataacaaccaagtcaccaacggaagcacaagtacaagaaacgcaataaatatcattgataccgctaaagtcacatcgatacgagctgctacggggcaatctatctatttctatgatcccatcacaaatccaggaaccgcagcttctaccgacacattgaacttaaacttagcagatgcgaacagtgagatcgagtatgggggtgcgattgtcttttctggagaaaagctttcccctacagaaaaagcaatcgctgcaaacgtcacctctactatccgacaacctgcagtattagcgcggggagatcttgtacttcgtgatggagtcaccgtaactttcaaggatctgactcaaagtccaggatcccgcatcttaatggatggggggactacacttagtgctaaagaggcaaatctttcgcttaatggcttagcagtaaatctctcctctttagatggaaccaacaaggcagctttaaaaacagaagctgcagataaaaatatcagcctatcgggaacgattgcgcttattgacacggaagggtcattctatgagaatcataacttaaaaagtgctagtacctatcctcttcttgaacttaccaccgcaggagccaacggaacgattactctgggagctctttctaccctgactcttcaagaacctgaaacccactacgggtatcaaggaaactggcagttgtcttgggcaaatgcaacatcctcaaaaataggaagcatcaactggacccgtacaggatacattcctagtcctgagagaaaaagtaatctccctctaaatagcttatggggaaactttatagatatacgctcgatcaatcagcttatagaaaccaagtccagtggggagccttttgagcgtgagctatggctttcaggaattgcgaatttcttctatagagattctatgcccacccgccatggtttccgccatatcagcgggggttatgcactagggatcacagcaacaactcctgccgaggatcagcttacttttgccttctgccagctctttgctagagatcgcaatcatattacaggtaagaaccacggagatacttacggtgcctctttgtatttccaccatacagaagggctcttcgacatcgccaatttcctctggggaaaagcaacccgagctccctgggtgctctctgagatctcccagatcattcctttatcgttcgatgctaaattcagttatctccatacagacaaccacatgaagacatattataccgataactctatcatcaagggttcttggagaaacgatgccttctgtgcagatcttggagctagcctgccttttgttatttccgttccgtatcttctgaaagaagtcgaaccttttgtcaaagtacagtatatctatgcgcatcagcaagacttctacgagcgtcatgctgaaggacgcgctttcaataaaagcgagcttatcaacgtagagattcctataggcgtcaccttcgaaagagactcaaaatcagaaaagggaacttacgatcttactcttatgtatatactcgatgcttaccgacgcaatcctaaatgtcaaacttccctaatagctagcgatgctaactggatggcctatggtaccaacctcgcacgacaaggtttttctgttcgtgctgcgaaccatttccaagtgaacccccacatggaaatcttcggtcaattcgcttttgaagtacgaagttcttcacgaaattataatacaaacctaggctctaagttttgtttctagattatcgaaaacgtgttaattaattgaacccaagcatctttctatgaaaatacccttgcacaaactcctgatctcttcgactcttgtcactcccattctattgagcattgcaacttacggagcagatgcttctttatcccctacagatagctttgatggagcgggcggctctacatttactccaaaatctacagcagatgccaatggaacgaactatgtcttatcaggaaatgtctatataaacgatgctgggaaaggcacagcattaacaggctgctgctttacagaaactacgggtgatctgacatttactggaaagggatactcattttcattcaacacggtagatgcgggttcgaatgcaggagctgcggcaagcacaactgctgataaagccctaacattcacaggattttctaacctttccttcattgcagctcctggaactacagttgcttcaggaaaaagtactttaagttctgcaggagccttaaatcttaccgataatggaacgattctctttagccaaaacgtctccaatgaagctaataacaatggcggagcgatcaccacaaaaactctttctatttctgggaatacctcttctataaccttcactagtaatagcgcaaaaaaattaggtggagcgatctatagctctgcggctgcaagtatttcaggaaacaccggccagttagtctttatgaataataaaggagaaactgggggtggggctctgggctttgaagccagctcctcgattactcaaaatagctcccttttcttctctggaaacactgcaacagatgctgcaggcaagggcggggccatttattgtgaaaaaacaggagagactcctactcttactatctctggaaataaaagtctgaccttcgccgagaactcttcagtaactcaaggcggagcaatctgtgcccatggtctagatctttccgctgctggccctaccctattttcaaataatagatgcgggaacacagctgcaggcaagggcggcgctattgcaattgccgactctggatctttaagtctctctgcaaatcaaggagacatcacgttccttggcaacactctaacctcaacctccgcgccaacatcgacacggaatgctatctacctgggatcgtcagcaaaaattacgaacttaagggcagcccaaggccaatctatctatttctatgatccgattgcatctaacaccacaggagcttcagacgttctgaccatcaaccaaccggatagcaactcgcctttagattattcaggaacgattgtattttctggggaaaagctctctgcagatgaagcgaaagctgctgataacttcacatctatattaaagcaaccattggctctagcctctggaaccttagcactcaaaggaaatgtcgagttagatgtcaatggtttcacacagactgaaggctctacactcctcatgcaaccaggaacaaagctcaaagcagatactgaagctatcagtcttaccaaacttgtcgttgatctttctgccttagagggaaataagagtgtgtccattgaaacagcaggagccaacaaaactataactctaacctctcctcttgttttccaagatagtagcggcaatttttatgaaagccatacgataaaccaagccttcacgcagcctttggtggtattcactgctgctactgctgctagcgatatttatatcgatgcgcttctcacttctccagtacaaactccagaacctcattacgggtatcagggacattgggaagccacttgggcagacacatcaactgcaaaatcaggaactatgacttgggtaactacgggctacaaccctaatcctgagcgtagagcttccgtagttcccgattcattatgggcatcctttactgacattcgcactctacagcagatcatgacatctcaagcgaatagtatctatcagcaacgaggactctgggcatcaggaactgcgaatttcttccataaggataaatcaggaactaaccaagcattccgacataaaagctacggctatattgttggaggaagtgctgaagatttttctgaaaatatcttcagtgtagctttctgccagctcttcggtaaagataaagacctgtttatagttgaaaatacctctcataactatttagcgtcgctatacctgcaacatcgagcattcctaggaggacttcccatgccctcatttggaagtatcaccgacatgctgaaagatattcctctcattttgaatgcccagctaagctacagctacactaaaaatgatatggatactcgctatacttcctatcctgaagctcaaggctcttggaccaataactctggggctctagagctcggaggatctctggctctatatctccctaaagaagcaccgttcttccagggatatttccccttcttaaagttccaggcagtctacagccgccaacaaaactttaaagagagtggcgctgaagcccgtgcttttgatgatggagacctagtgaactgctctatccctgtcggcattcggttagaaaaaatctccgaagatgaaaaaaataatttcgagatttctctagcctacattggtgatgtgtatcgtaaaaatccccgttcgcgtacttctctaatggtcagtggagcctcttggacttcgctatgtaaaaacctcgcacgacaagccttcttagcaagtgctggaagccatctgactctctcccctcatgtagaactctctggggaagctgcttatgagcttcgtggctcagcacacatctacaatgtagattgtgggctaagatactcattctagttcctactttcctccctaaacttttagggaggaattcttataaaaaccctgtagattcttaacttactagtctctcctttcctcttgctttctttaatttattgcagtatgtggtgaaataatttgttaaaccacctatagccctctacatgaaatcctctcttcattggtttttaatctcgtcatctttagcacttcccttgtcactaaatttctctgcgtttgctgctgttgttgaaatcaatctaggacctaccaatagcttctctggaccaggaacctacactcctccagcccaaacaacaaatgcagatggaactatctataatctaacaggggatgtctcaatcaccaatgcaggatctccgacagctctaaccgcttcctgctttaaagaaactactgggaatctttctttccaaggccacggctaccaatttctcctacaaaatatcgatgcgggagcgaactgtacctttaccaatacagctgcaaataagcttctctccttttcaggattctcctatttgtcactaatacaaaccacgaatgctaccacaggaacaggagccatcaagtccacaggagcttgttctattcagtcgaactatagttgctactttggccaaaacttttctaatgacaatggaggcgccctccaaggcagctctatcagtctatcgctaaaccccaacctaacgtttgccaaaaacaaagcaacgcaaaaagggggtgccctctattccacgggagggattacaattaacaatacgttaaactcagcatcattttctgaaaataccgcggcgaacaatggcggagccatttacacggaagctagcagttttattagcagcaacaaagcaattagctttataaacaatagtgtgaccgcaacctcagctacagggggagccatttactgtagtagtacatcagcccccaaaccagtcttaactctatcagacaacggggaactgaactttataggaaatacagcaattactagtggtggggcgatttatactgacaatctagttctttcttctggaggacctacgctttttaaaaacaactctgctatagatactgcagctcccttaggaggagcaattgcgattgctgactctggatctttgagtctttcggctcttggtggagacatcacttttgaaggaaacacagtagtcaaaggagcttcttcgagtcagaccactaccagaaattctattaacatcggaaacaccaatgctaagattgtacagctgcgagcctctcaaggcaatactatctacttctatgatcctataacaactagcatcactgcagctctctcagatgctctaaacttaaatggtcctgaccttgcagggaatcctgcatatcaaggaaccatcgtattttctggagagaagctctcggaagcagaagctgcagaagctgataatctcaaatctacaattcagcaacctctaactcttgcgggagggcaactctctcttaaatcaggagtcactctagttgctaagtccttttcgcaatctccgggctctaccctcctcatggatgcagggaccacattagaaaccgctgatgggatcactatcaataatcttgttctcaatgtagattccttaaaagagaccaagaaggctacgctaaaagcaacacaagcaagtcagacagtcactttatctggatcgctctctcttgtagatccttctggaaatgtctacgaagatgtctcttggaataaccctcaagtcttttcttgtctcactcttactgctgacgaccccgcgaatattcacatcacagacttagctgctgatcccctagaaaaaaatcctatccattggggataccaagggaattgggcattatcttggcaagaggatactgcgactaaatccaaagcagcgactcttacctggacaaaaacaggatacaatccgaatcctgagcgtcgtggaaccttagttgctaacacgctatggggatcctttgttgatgtgcgctccatacaacagcttgtagccactaaagtacgccaatctcaagaaactcgcggcatctggtgtgaagggatctcgaacttcttccataaagatagcacgaagataaataaaggttttcgccacataagtgcaggttatgttgtaggagcgactacaacattagcttctgataatcttatcactgcagccttctgccaattattcgggaaagatagagatcactttataaataaaaatagagcttctgcctatgcagcttctctccatctccagcatctagcgaccttgtcttctccaagcttgttacgctaccttcctggatctgaaagtgagcagcctgtcctctttgatgctcagatcagctatatctatagtaaaaatactatgaaaacctattacacccaagcaccaaagggagagagctcgtggtataatgacggttgcgctctggaacttgcgagctccctaccacacactgctttaagccatgagggtctcttccacgcgtattttcctttcatcaaagtagaagcttcgtacatacaccaagatagcttcaaagaacgtaatactaccttggtacgatctttcgatagcggtgatttaattaacgtctctgtgcctattggaattaccttcgagagattctcgagaaacgagcgtgcgtcttacgaagctactgtcatctacgttgccgatgtctatcgtaagaatcctgactgcacgacagctctcctaatcaacaatacctcgtggaaaactacaggaacgaatctctcaagacaagctggtatcggaagagcagggatcttttatgccttctctccaaatcttgaggtcacaagtaacctatctatggaaattcgtggatcttcacgcagctacaatgcagatcttggaggtaagttccagttctaaaagcgttcctgatcccttagaaattctaagagatcctgagtgtatctagggacttctcaaagacaatgcgccttgtttagacgaggagaagtcgaaagatcagaggaatctaagaactagaaaaaatcccagattacaagaggtcgaagattcaaagaagtcgctagatcacaagaaagaatgggcagagtacgtgatctcacgaactctgcccgtcttagaatccaaagactttttagtatactaagactgtctatgatccaatagccaaagactcttgaatatttaaatgttttctatgatccgaaaactcttagagtcgataaaaactccggattctttatccccagatctctttagcaatctctttcacaaaggcgatcttcttccactgttcttcttcagtcattctatggtctccctcacaagaagcaaacccacattgcgggctcaaagaaagtctctctaagggaatgtagctcgcagcttcataaatacgagaaaccacagcatctcgatcttcaatacaagaatggttgctggagatcaatcccaagcagacgtgtttctctccagagacgtaagctaaaggctcagcacctcctgaatacttatcatcaagagcccaataatagtgataactatccacatcggtcttagcaaataaaggctcctctatagaatcataagctcgtctagagaaaaactcggcctgataatcaccacgacagacatgcagacttacaaaaagatcctcgggtctatccttcatcactaaattatggatccataaaaactgttctaaaatttcctgcaacctgtcatgagaatcaacaccataccaagaaggcgctcgtatatccaagaggcgacaccaagcacaatcgtccaactgcaaattacgacaacctgcagcataaagatcttggatgacttggcgataataaaagacaatatcatcaattagctcttgattcgtaggataaaacttccgagtatttttcagattaggagcaaaaatcatctcatggaaaaattgtgatggagaaggaatcgtttgttttgcttttgcatttcccttctcaaaagttttgacaaactcgaaatgttctataaacggatgttttgatacggagattttatctttaagatacactccaatttcagggtcattagagtccctgcgacgatccacgccatggaatccccacataaagtcgaaatcccaactatacctacggaattccccatcagtaaaaaagataagacctgcttctgtttgcttttttatgagattacgaatagcagcatcttcgacaactcgcatctgctcatagacaattcttccttcttcaaaatcagagcgtgctcgtgtaagactttcaggacgtaagaaacttcccacaacatcaaaatgacattgctcaggttgttggaatgggctcatcatttccatccttagagatgatcctaataaaatacatttccactcatggatctctcttctcgatggttgaataaattaaagacaagaaaacagctagatcaaaacataaagtacgattgtaaaagttactgcctgaggggaatctcacaaatcttaggatgggtgtaacaacaccccttcccttaaaaaagaaagagacgtaccgtctctgcaactctaatctttgcagctattctctataagaagcataacaaaaaccacttaaaatttaggatctaaaaatagtgaattatcttattcaataagaattaaagaaacgtattttaaagaacgggtttctattaaaaaatttccttaattttaaaacgtgtttgtaacaagaaaggcagagtacgtgacctcacgaactctgccctcttgcctttttaatccccgatctctcctggttcaaaaacaaggtgagtcgtgtttaagaaaatcctaaatgcgatctctctcagaatttctgagacatgagagacgctcctagaattggaacttacccccaagatctacattataaatccgtgaggatccacgaacttcaaagacaaactggccgagcacttcaaacataggagagaaggcgtagtgactgcctgcacgcacttgcaaggcctgtcgtgctaagttattggcataagtttcccaagaggctccgctgattacaagtgctgtagtgcatttgggatcattgcggataagatcaggaacataggataaagtcagatcataagaaaagtcattacaatcagagaacttctcaaacttcacccctataggcaaagataaattgaagaggttgctgtcatcaaaagatcttccttctgtacctttctccgagaagctgtcctgacgtatataggtcagattcagtttgatgtatggagcataggtatcaaaacaatgcaggtattcaggataagaatgagaagaagctcccaacatcatgttaaaagcattattcccccaagaacctttcacctcaggatacgcagtatactttgtcttcagatcattactgacgtggctataagcgagctgcccttctaaaacgaggggtttatgactccaagagccaggaagtttatctaagagacaacctatgaacccactacattctgtaatgtgttggatatagaaggctcctgcataggtatcagtatgatttttagcgactaagaaatctttatcgctaccaaagagttggcaaaaggcaaagctaattaagttttcagaacaagtttgcgctgcacctccgatagcatatccaccagatttatgacggtatttgcgtttttcccctttcttatctttatctaagaaattggcgactcccgcagcccagaagcctcgatctgaacaaagagtcaaagcacttctctctatgacaccttgaatcgcttggatgtctgaaaaagatccccaaaggctattaggaactaaaggtccttgacgctcaggattcggaaggtagcctgtattggtccaagctaatgtcgctgtcttagtctttggagtgcttgcggtatcatcaacccaagtcattccccaagtaccttgatacccatagtgcgtaggagttgctactgtaggaaccgctggaacatctgtagttgttgcagtacccagagcagagagctgcacaaatgaaaagtcttgagtttttcctaagtcgtgattttcataagcattcccttggttatccaaaagaagaatcggaccactaagggctacatttttacttgctgcagaagcagcaattacaactttcttaccctcgcctaaagagtctacaggaatggaaagacctgttaaagtgacctcctctgtacttgcttttaacgttgtgcccgcatccataataacagaggaacccgcggtctgagtaaagcctttcgtatcgagagtgacaccacgtttaagtactaaatttcctgcagttagagttacaggctgcttcagcgtagaagtgaggttgtctgcaacttttgcttcatcttcagagagcttttcaccagaaaaaacaatcgacccactataatctgtactattacctgcatcagccttattgagatttaaagtatctgtagaatccgcagccgtattagcagtaatcggatcgtagaaaaagatgctatgcccagatattgcacgtaaattcgtgatctttgcagtagatcctatgtcaatagaatttctttttgtagtttgtggtgtagttgcaacaatggcattcccattgaaggtaatgtcccctgcttctgctgaaagactacactctccagctgccagtatagaaatggctccaccattacctgcagtggtaccttggactatattgttagaaaaggagatacccccccccccccggaagccagtgtaagcttcttagcataaatggctccgccattagctacagcttggtttcctgagaaagttacactctgattcccagatatggtaacatcggcatctccagaaagagctcctccatttcctgcggtcgctgtcacactattttcagaaaatacaagagacgtattccctgtaattgtacagtttcctgtgctatttatagctccacctgcagcttcagcaatattgttcgagaagagggtaggagccgtattatttgtaatatctacagtaccagtagcacaaatagccccaccttttttccctgttgcgctcgatttattcccttcaaaagaaatcgatcccgtgctgtttttcaaagaaagattcttggtagaaatggctccgccattttcctcacagtaatcttgtttaaataaaatagttccattgttatcaaatgtaagatcccctccacatttaactgcaccttttcctgagggggttgtgattaccgatgatggggccgctaagaaagtaagactcgaaaatcctgttagcgacagatttttatcagttgtaacagaaagtgctgcgccttcagcactagacttaatatttaaaaaagaaagtgagtaccccttaccggcaaagcttaaagattccgtagtgtcagaaaaacaacccttcgttaaagctgccgaatccccaaggttttgcagagttatatctcctgtcagagtatagtctattccagtagtcgtatttttaggagtataggtgcctgtgttagtacttccgtcaaagctatcagaggggcctatattttcagcagttgcagcaaaaacagtggaacaactagtaaaacatgccaatgtcgaagagagcactaaccaggaaaattgcgatttcataaacccactttattattaaattcttacttgcgtcatataaaatagaaaactcagagagtcaagataaaaattcttgacagctgttttgtcatctttaacttgatttacttattttgtttctatattgatgcgaatagttctctaaaaaacaaaagcattaccatgaagacttcgattccttgggttttagtttcctccgtgttagctttctcatgtcacctacagtcactagctaacgaggaacttttatcacctgatgatagctttaatggaaatatcgattcaggaacgtttactccaaaaacttcagccacaacatattctctaacaggagatgtcttcttttacgagcctggaaaaggcactcccttatctgacagttgttttaagcaaaccacggacaatcttaccttcttggggaacggtcatagcttaacgtttggctttatagatgctggcactcatgcaggtgctgctgcatctacaacagcaaataagaatcttaccttctcagggttttccttactgagttttgattcctctcctagcacaacggttactacaggtcagggaacgctttcctcagcaggaggcgtaaatttagaaaatattcgtaaacttgtagttgctgggaatttttctactgcagatggtggagctatcaaaggagcgtctttccttttaactggcacttctggagatgctctttttagtaacaactcttcatcaacaaagggaggagcaattgctactacagcaggcgctcgcatagcaaataacacaggttatgttagattcctatctaacatagcgtctacgtcaggaggcgctatcgatgatgaaggcacgtcgatactatcgaacaacaaatttctatattttgaagggaatgcagcgaaaactactggcggtgcgatctgcaacaccaaggcgagtggatctcctgaactgataatctctaacaataagactctgatctttgcttcaaacgtagcagaaacaagcggtggcgccatccatgctaaaaagctagccctttcctctggaggctttacagagtttctacgaaataatgtctcatcagcaactcctaaggggggtgctatcagcatcgatgcctcaggagagctcagtctttctgcagagacaggaaacattacctttgtaagaaatacccttacaacaaccggaagtaccgatactcctaaacgtaatgcgatcaacataggaagtaacgggaaattcacggaattacgggctgctaaaaatcatacaattttcttctatgatcccatcacttcagaaggaacctcatcagacgtattgaagataaataacggctctgcgggagctctcaatccatatcaaggaacgattctattttctggagaaaccctaacagcagatgaacttaaagttgctgacaatttaaaatcttcattcacgcagccagtctccctatccggaggaaagttattgctacaaaagggagtcactttagagagcacgagcttctctcaagaggccggttctctcctcggcatggattcaggaacgacattatcaactacagctgggagtattacaatcacgaacctaggaatcaatgttgactccttaggtcttaagcagcccgtcagcctaacagcaaaaggtgcttcaaataaagtgatcgtatctgggaagctcaacctgattgatattgaagggaacatttatgaaagtcatatgttcagccatgaccagctcttctctctattaaaaatcacggttgatgctgatgttgatactaacgttgacatcagcagccttatccctgttcctgctgaggatcctaattcagaatacggattccaaggacaatggaatgttaattggactacggatacagctacaaatacaaaagaggccacggcaacttggaccaaaacaggatttgttcccagccccgaaagaaaatctgcgttagtatgcaataccctatggggagtctttactgacattcgctctctgcaacagcttgtagagatcggcgcaactggtatggaacacaaacaaggtttctgggtttcctccatgacgaacttcctgcataagactggagatgaaaatcgcaaaggcttccgtcatacctctggaggctacgtcatcggtggaagtgctcacactcctaaagacgacctatttacctttgcgttctgccatctctttgctagagacaaagattgttttatcgctcacaacaactctagaacctacggtggaactttattcttcaagcactctcataccctacaaccccaaaactatttgagattaggaagagcaaagttttctgaatcagctatagaaaaattccctagggaaattcccctagccttggatgtccaagtttcgttcagccattcagacaaccgtatggaaacgcactatacctcattgccagaatccgaaggttcttggagcaacgagtgtatagctggtggtatcggcctagaccttccttttgttctttccaacccacatcctcttttcaagaccttcattccacagatgaaagtcgaaatggtttatgtatcacaaaatagcttcttcgaaagctctagtgatggccgtggttttagtattggaaggctgcttaacctctcgattcctgtgggtgcgaaattcgtgcagggggatatcggagattcctacacctatgatctctcaggattctttgtttccgatgtctatcgtaacaatccccaatctacagcgactcttgtgatgagcccagactcttggaaaattcgcggtggcaatctttcaagacaggcatttttactgaggggtagcaacaactacgtctacaactccaattgtgagctcttcggacattacgctatggaactccgtggatcttcaaggaactacaatgtagatgttggtaccaaactccgattctagattgctaaaactccctagttcttctagggagttttctcatacttttagggaaatatttgctatagggaatgctttccttgcaaactgtaaaaaataacatttgtccctcttcaaaaaagatttcttttaataatttctagttataattttattttaaaaacagttaaataattaatagacaataatctattcttattgacttctttttttcttgtttattaaagttgcttcaaccttattgatttaacgaggaaaccatgaccatacttcgaaattttcttacctgctcggctttattcctcgctctccctgcagcagcacaagttgtatatcttcatgaaagtgatggttataacggtgctatcaataataaaagcttagaacctaaaattacctgttatccagaaggaacttcttacatctttctagatgacgtgaggatttccaacgttaagcatgatcaagaagatgctggggtttttataaatcgatctgggaatctttttttcatgggcaaccgttgcaacttcacttttcacaaccttatgaccgagggttttggcgctgccatttcgaaccgcgttggagacaccactctcactctctctaatttttcttacttagcgttcacctcagcacctctactacctcaaggacaaggagcgatttatagtcttggttccgtgatgatcgaaaatagtgaggaagtgactttctgtgggaactactcttcgtggagtggagctgcgatttatactccctaccttttaggttctaaggcgagtcgtccttcagtaaatctcagcgggaaccgctacctggtgtttagagacaatgtgagccaaggttatggcggcgccatatctacccacaatctcacactcacgactcgaggaccttcgtgttttgaaaataatcatgcttatcatgacgtgaatagtaatggaggagccattgccattgctcctggaggatcgatctctatatccgtgaaaagcggagatctcatcttcaaaggaaatacagcatcacaagacggaaatacaatacacaactccatccatctgcaatctggagcacagtttaagaacctacgtgctgtttcagaatccggagtttatttctatgatcctataagccatagcgagtcgcataaaattacagatcttgtaatcaatgctcctgaaggaaaggaaacttatgaaggaacaattagcttctcaggactatgcctggatgatcatgaagtttgtgcggaaaatcttacttccacaatcctacaagatgtcacattagcaggaggaactctctctctatcggatggggttaccttgcaactgcattcttttaagcaggaagcaagctctacgcttactatgtctccaggaaccactctgctctgctcaggagatgctcgggttcagaatctgcacatcctgattgaagataccgacaactttgttcctgtaaggattcgcgccgaggacaaggatgctcttgtctcattagaaaaacttaaagttgcctttgaggcttattggtccgtctatgactttcctcaatttaaggaagcctttacgattcctcttcttgaacttctagggccttcttttgacagtcttctcctaggggagaccactttggagagaacccaagtcacaacagagaatgacgccgttcgaggtttctggtccctaagctgggaagagtaccccccttctctggataaagacagaaggatcacaccaactaagaaaactgttttcctcacttggaatcctgagatcacttctacgccataatctctaagtctacactataattaagggaatcccctttaagaagattttgggacctatctgtattcagagataggtccctctatgcacacatgttcacgagtctcgggcgtagcgccattttctactttacaggttctctaaaacatcttcgtttgggagaatttcttgagatttttcaaaaatagaatcgccattttctatcaagtattcttctaagaaagcaatgtaagaaatgggaaaatgccctttaaaatatcctgtaatcttaaagctgtcaaaattaagagattaaaactgtgtcttattgtacttgtttttttacagcctttcccttatttgtaggataatctggtttcatctctacgtgcaaatgaaaacgtctattcgtaagttcttaatttctaccacactggcgccatgttttgcttcaacagcgtttactgtagaagttatcatgccttccgagaactttgatggatcgagtgggaagatttttccttacacaacactttctgatcctagagggacactctgtattttttcaggggatctctacattgcgaatcttgataatgccatatccagaacctcttccagttgctttagcaatagggcgggagcactacaaatcttaggaaaaggtggggttttctccttcttaaatatccgttcttcagctgacggagccgcgattagtagtgtaatcacccaaaatcctgaactatgtcccttgagtttttcaggatttagtcagatgatcttcgataactgtgaatctttgacttcagatacctcagcgagtaatgtcatacctcacgcatcggcgatttacgctacaacgcccatgctctttacaaacaatgactccatactattccaatacaaccgttctgcaggatttggagctgccattcgaggcacaagcatcacaatagaaaatacgaaaaagagccttctctttaatggtaatggatccatctctaatggaggggccctcacgggatctgcagcgatcaacctcatcaacaatagcgctcctgtgattttctcaacgaatgctacagggatctatggtggggctatttaccttaccggaggatctatgctcacctctgggaacctctcaggagtcttgttcgttaataatagctcgcgctcaggaggcgctatctatgctaacggaaatgtcacattttctaataacagcgacctgactttccaaaacaatacagcatctccacaaaactccttacctgcacctacacctccacctacaccaccagcagtcactcctttgttaggatatggaggcgccatcttctgtactcctccagctacccccccaccaacaggtgttagcctgactatatctggagaaaacagcgttacattcctagaaaacattgcctccgaacaaggaggagccctctatggcaaaaagatctctatagattctaataaatctacaatatttcttggaaatacagctggaaaaggaggcgctattgctattcccgaatctggggagctctctctatccgcaaatcaaggtgatatcctctttaacaagaacctcagcatcactagtgggacacctactcgcaatagtattcacttcggaaaagatgccaagtttgccactctaggagctacgcaaggctataccctatacttctatgatccgattacatctgatgatttatctgctgcatccgcagccgctactgtggtcgtcaatcccaaagccagtgcagatggtgcgtattcagggactattgtcttttcaggagaaaccctcactgctaccgaagcagcaacccctgcaaatgctacatctacattaaaccaaaagctagaacttgaaggcggtactctcgctttaagaaacggtgctaccttaaatgttcataacttcacgcaagatgaaaagtccgtcgtcatcatggatgcagggaccacattagcaactacaaatggagctaataatactgacggtgctatcaccttaaacaagcttgtaatcaatctggattctttggatggcactaaagcggctgtcgttaatgtgcagagtaccaatggagctctcactatatccggaactttaggacttgtgaaaaactctcaagattgctgtgacaaccacgggatgtttaataaagatttacagcaagttccgattttagaactcaaagcgacttcaaatactgtaaccactacggacttcagtctcggcacaaacggctatcagcaatctccctatgggtatcaaggaacttgggagtttaccatagacacgacaacccatacggtcacaggaaattggaaaaaaaccggttatcttcctcatccggagcgtcttgctcccctcattcctaatagcctatgggcaaacgtcatagatttacgagctgtaagtcaagcgtcagcagctgatggcgaagatgtccctgggaagcaactgagcatcacaggaattacaaatttcttccatgcgaatcataccggtgatgcacgcagctaccgccatatgggtggaggctacctcatcaatacctacacacgcatcactccagatgctgcgttaagtctaggttttggacagctgtttacaaaatctaaggattacctcgtaggtcacggtcattctaacgtttatttcgctacagtatactctaacatcaccaagtctctgtttggatcatcgagattcttctcaggaggcacttctcgagttacctatagccgtagcaatgagaaagtaaagacttcatatacaaaattgcctaaagggcgctgctcttggagtaacaattgctggttaggagaactcgaagggaaccttcccatcactctctcttctcgcatcttaaacctcaagcagatcattccctttgtaaaagctgaagttgcttacgcgactcatgggggcatccaagaaaatacccccgaggggaggatttttggacacggtcatctactcaacgttgcagttcccgtaggcgtccgctttggtaaaaattctcataatcgaccagatttttacactataatcgtagcctatgctcctgatgtctatcgtcacaatcctgattgcgatacgacattacctattaatggagctacgtggacctctatagggaataatctaaccagaagtactttgctagtacaagcatccagccatacttcagtaaatgatgttctagagatcttcgggcactgtggatgtgatattcgcagaacctcccgtcaatatactctagatataggaagcaaattacgattttaaaccttatttaacgacagggttgaggcatgcctctttctttcaaatcttcatctttttgtctacttgcctgtttatgtagtgcaagttgcgcgtttgctgagactagactcggagggaactttgttcctccaattacgaatcagggtgaagagatcttactcacttcagattttgtttgttcaaacttcttgggggcgagtttttcaagttcctttatcaatagttccagcaatctctccttattagggaagggcctttccttaacgtttacctcttgtcaagctcctacaaatagtaactatgcgctactttctgccgcagagactctgaccttcaagaatttttcttctataaactttacagggaaccaatcgacaggacttggcggcctcatctacggaaaagatattgttttccaatctatcaaagatttgatcttcactacgaaccgtgttgcctattctccagcatctgtaactacgtcggcaactcccgcaatcactacagtaactacaggagcctctgctctccaacctacagactcactcactgtcgaaaacatatcccaatcgatcaagttttttgggaaccttgccaacttcggctctgcaattagcagttctcccacggcagtcgttaaattcatcaataacaccgctaccatgagcttctcccataactttacttcgtcaggaggcggcgtgatttatggaggaagctctctcctttttgaaaacaattctggatgcatcatcttcaccgccaactcctgtgtgaacagcttaaaaggcgtcaccccttcatcaggaacctatgctttaggaagtggcggagccatctgcatccctacgggaactttcgaattaaaaaacaatcaggggaagtgcaccttctcttataatggtacaccaaatgatgcgggtgcgatctacgccgaaacctgcaacatcgtagggaaccagggtgccttgctcctagatagcaacactgcagcgagaaatggcggagccatctgtgctaaagtgctcaatattcaaggacgcggtcctattgaattctctagaaaccgcgcggagaagggtggagctattttcataggcccctctgttggagaccctgcgaagcaaacatcgacacttacgattttggcttccgaaggtgatattgcgttccaaggaaacatgctcaatacaaaacctggaatccgcaatgccatcactgtagaagcagggggagagattgtgtctctatctgcacaaggaggctcacgtcttgtattttatgatcccattacacatagcctcccaaccacaagtccgtctaataaagacattacaatcaacgctaatggcgcttcaggatctgtagtctttacaagtaagggactctcctctacagaactcctgttgcctgccaacacgacaactatacttctaggaacagtcaagatcgctagtggagaactgaagattactgacaatgcggttgtcaatgttcttggcttcgctactcagggctcaggtcagcttaccctgggctctggaggaaccttagggctggcaacacccacgggagcacctgccgctgtagactttacgattggaaagttagcattcgatcctttttccttcctaaaaagagattttgtttcagcatcagtaaatgcaggcacaaaaaacgtcactttaacaggagctctggttcttgatgaacatgacgttacagatctttatgatatggtgtcattacaatctccagtagcaattcctatcgctgttttcaaaggagcaaccgttactaagacaggatttcctgatggggagattgcgactccaagccactacggctaccaaggaaagtggtcctacacatggtcccgtcccctgttaattccagctcctgatggaggatttcctggaggtccctctcctagcgcaaatactctctatgctgtatggaattcagacactctcgtgcgttctacctatatcttagatcccgagcgttacggagaaattgtcagcaacagcttatggatttccttcttaggaaatcaggcattctctgatattctccaagatgttcttttgatagatcatcccgggttgtccataaccgcgaaagctttaggagcctatgtcgaacacacaccaagacaaggacatgagggcttttcaggtcgctatggaggctaccaagctgcgctatctatgaactacacggaccacactacgttaggactttctttcgggcagctttatggaaaaactaacgccaacccctacgattcacgttgctcagaacaaatgtatttactctcgttctttggtcaattccctatcgtgactcaaaagagcgaggccttaatttcctggaaagcagcttatggttattccaaaaatcacctaaataccacctacctcagacctgacaaagctccaaaatctcaagggcaatggcataacaatagttactatgttcttatttctgcagaacatcctttcctaaactggtgtcttcttacaagacctctggctcaagcttgggatctttcaggttttatttccgcagaattcctaggtggttggcaaagtaagttcacagaaactggagatctgcaacgtagctttagtagaggtaaagggtacaatgtttccctaccgataggatgttcttctcaatggttcacaccatttaagaaggctccttctacactgaccatcaaacttgcctacaagcctgatatctatcgtgtcaaccctcacaatattgtgactgtcgtctcaaaccaagagagcacttcgatctcaggagcaaatctacgccgccacggtttgtttgtacaaatccatgatgtagtagatctcaccgaggacactcaggcctttctaaactatacctttgacgggaaaaatggatttacaaaccaccgagtgtctacaggactaaaatccacattttaaaactctaagctctgcttagagttttctgtagccccggtcgtcttagaatcctctatccatcatcgaagaacttagcaatgaaggccaagattctcactctatgagaacccccccccctctctcaagtctatttgaaaagaaagaatatcttttgaatctatagtctgttttggaaagaagggaatacgatctgctttgcatccctagggaaagcatctttcatcaatgcgattacttcacgttgcaatggcttcacttgtttatgcatacgttaacaaggattatgaatccttgaaagactcgctctcctctcgattctcgtgtagaattcactccctaggttttatctttagagtctgcagcagatgaaactttaggattcagttcctcatcctcatcatcagaaatcaaagggtctttaccagaaatgggcaacacgtcactggggcataagaactctatttggctcgctaacttatcgaatgctgcacagttcacaatgagtgtatgctcttgagaggtacggacgatactactatcttctatgactatgccctgagaacttgtgtacggtatcatgtctaaatttgaaacgtaagatactaaagcatctgttactgaagcctctagagcttctctctcataagcaaaaagatccggattgcggaatctccacacagactgttttatcacggcgtctagagcaaaggctagatttttctctgtggagactgtgttgcagaggagtgctcctaactgctcttcagttaaagacccttgcattgtttgttcttgtttctctctgatctcctccgcgtaggcaatatgactggagacccaagggagatgctcatcatcgaaagcgaccactttacatcctgaagcataggcatcagcagcttctttttcacgagaaacaaaaattctttcggatgccaactgcaaattccgaatatcggggtgcccttcaggaagctctgagatcaccaccgtcatagatctcccttcatcggcattcaatagcagacgttgttgaaccgtagtctccccggagagatcacaacgcactacattcagatagctatagccttcatcgctaagctcttcaataagctgagagactgcttcaggaggcaggccgaggatattaggttcagaatgattacaaacgacaactacgtctttctccttctcatcataggacactaaaagtaaaaagcgcagccacactctacggaagtatcgttagcaaaatttagagatacctcacgaagctctttcttacttatgttcttagcatccacaaatgctgaaaataacaaaattttcagctcttcatgggtgagatctgcaagataggaatggcagtgagacccttgagataaaggagcatggagtcgttgccggtctaagagcaatcctgaatcctgggctccaagtcccattcccaaagtatgcaactgatggtgtgtacgagaaatctctttataaagctctgtcttatccttttcggtatttataggtaaggaaagccgagatctatacctagatggcaatgtgtgcataacattcacccagggaacagtacctaacgaagtccctagggcctgctgtaaaattttaccctcccttaagtaagaatccttcccataacagccgaccataaggtcaaagtgtttcgtatcttcgccctcggcaccctgaggttccaagacggaaagacactgaacttcagaatgtagacctagagaacggagctgtttttccttatcagaggagatatcccctacccactccttattaaaatcgataagaagatatagagttgtctttgatttgggatagagttgaatgacctcattcgccaagcgtactaaattctcttgttcttcaggactgacgagatctataccaacaatagctatagagtccaactgaggagtaggggcataactataggatctggtgatgcgattgcgaactctagaaaaggctttgccaagctcgctaacatgaactcccttatcgagtttaagaacctcactagaggccatatctgcataaggattctcttgatattgcccgtggactttatctagatcttcaacctcgatagttttcctaaggctctttagctgattttcgattctagaaatatgatctcggcccgcgatcttttctactttcagtataggagcaatatctgaagggaacccagggtgtgagactcccctctcgaagcaatgagagatcaaccaatcgactcccataacaagatgccctacaatggggatggccttaatcacccctaaagcgaagtgggtaattcgagaatataaaggacgtgagaaattaaacgcctgcacaaagtgatgacgaactacagaaaaccaaccatgtaagcaatgagtcataagaaatttacgtttagattcaaaagtacaaggaatttaaatgatgtgccaaaaatacaaaataaacaatttgtattagacatcaagtacactgaaaataaaacgctcttgttgagcacgttttcctaacaaatacgttatcgattcttaggggaaataggttctgacaattagatttgagagactctgttatgagagagagaccataggcacaaagacacgcctgtaaagcagagtatcctgattcaaagcttagacattgcgtatcgttatcctcaaaccgtcgaattttctttgtctctatttgttggctcctaagtgagcttcctcctctggaattggagatatttctgaaggagctctgctaagagtcgatcctagagattcaacagcttcatctaatgctgtgaaatctatagacaattgcgcggattgctgcgtttctagattcccctgaggatctttttttgcgttgttaggtagtgatgtacagtagtaaagagttgttcccctaacgcccgtctctcaatagagagaagttctggcatacgggatctccatatagactggcggattgcagcatctcaagaacaagcgaagttctgttgcgccgtcagctgattacaaacgtaaatctcgctctcgtcttgatccaaagcagcttcttgtttctgttttctaacttctcttttccaaagaccatgctttctattccacagattagattctcgctccaaagttaagacttcttccatcataaagttcgcgcatcctgacgtatagacatcgacagcatagcactctttaccacaaagcattccttcagacgccaaatgcaaacagcggatatctccttgagatactgaatcctcacagaaaatcatggtaaaggctttctcttgagaactttcatttaagatcctacgttcttctacacacatgctattagatctaaaggcaaaaatattgaagtgcgaataccctcgacactctagctccataataaagtgttggaagcttggctcctccttccagtcggtaccccaccaagaatcacatacaacgacaaccacattgcgatcacttctgctcatcctctcaaaaaagccaaagtgctgccttaagtaagttttgctatttaagataagatttagagatataggttgcagtatggtactgctcaactccttaggattcagaaatgccgctaaaattgttttttgtaacccgggattttctaagtctgcaaggtaggaatgacaataatgcccttcagataagggagcatgcacccgttttgggtccatcaagatccctgaccgactatctccaaaccccaaactaagaaccgaagagcgctctcctacgtataccaatcgagaatatagctgttctttttctaattcagagtactctagagctttctctttatctcccttcatctccaaagatgaaaatggagagaaatcccacaaggattgtgaaagaggcttttgccccacatgaatccaaggggtttcctcccctgacttttctaactcttcctgaatctgattcaacgtaccttgatcattctccccatgatacaccatccaacagtcacaagttgcttgtttgactacatcaccctgattaaagtccaaacaagcaatcttggggtttagttcgcaatcactaagtaacttccgattctttttgtccatagcattgcgaccaccagaagctgttagatatagagaaatcgtagcgtcaggatagagtctttgagtttcattacagagacgggctagatgcaagaagtcgtcaacttcaaaaggattcatatcgtttcctatgatgtaaatcttctgcagttttggccgtggagcttgcaaatacgcctgtcttacacgattacgaattttagagaaggcaagccctaacgttgcatcttgaacttcgggatagagagtgagaacttctacaggttggattcccccgaaaggatgcacaggaatcttcccatggaccttatcctcatcttcaggagccacagcgactctctgcctcttcaaagtctccactacacgagcaatgtgatcgcgaccagcaactttctctgttttcagaagactcaccacatcagagacaaatgtcggcttggtcacgaaactctctaaatacctagaaacgagccactctatcccaacaataatgtgacccacaacagggatccccttgatgacccctaatacaaattccgtaatacgagcacaaaacggcaaagaaaaatcaaaggctcgataaaagtgctcacgaactatagaaaaccaggcagataaacaagaagccataacacgactaggaagaaatacttaggaaagaagtatttaaaaaaaacttgaaaaaagcaatctctaagatacttagcgactcctatagccacaagaaattcgctatttttaaaattagaaagaggagacctgagaaaggttgtaaaaagcgcttagatacaactatttagaatcctatcctggaaatcagaaatctacggaatactagtgtagaaagaacaaatatagagagagtcctctaaggagtttgtgcactcctggggtttgtgaaattaagatattcctaggcaaacccttcctggaatcctaggtacatggaccacggattccatctggagataagaaatttctctagtatttttactttctaactgccttcattttgcgaggaatcagggttactatctggattaggaacgggacgcgtaggatcattgcctgaatctgcagggacttcggctgggaggacttgcaccatgcgatctagctcttcgaagctgataacgacctcatgttcttcggtagttcttttccccatattctcattacgctcctgactccctaaataggaaaatatcgcagttaagaactcctcgcctagtgcctttctttccatagtaagaagacctttcgaacggaatctccagatcgcctgttttaccacagcatctagagaaaatacaaaattctgttgtgtagtgagcatgctgctcaattgatcctgagaataaattactggttctctggcttcttctcctgcttcatcttcgacacgtgcctcccattgtctatattcaatagcctgaggactctgcatctcagaaaactgaatgcaggaacatccagaggcacaaatatctgctacgctggggagatccttagcaaccataccttctgcagctagctgcaaacaacggaaatctgctgcactaatgggatcctcaaataagatcaatgtgaaagacttcccttcagaacgatctccaaagaactgacgttcttttacaatcattttccgtgatttataggagaaaatgttcaaatagctatatccagacatttgtaatcttctggtcagaatgttcattgagtcaggatcaagatcttctggacgaggagttccgtgggcaagggtaactatgtttctcccttcttgctgacccgcaacaaggcggaaaaataacgagtccaattctaatggcaatctagcgatattgaatgctacaggacgaagatcctcgctactaagattgccaggatctaggaaaggcgaaaggactaaagttcgtagatcctcattttctatatccgcaaggtaggaatgacaataatgcccttgggatagaggagcatagattctatccgggtccatcaggagtcctgcatcctctggttttaatcccaaaccaagcatatactcatggtgatacgatcgactcagttgtccgtacaaggaatccttatccccctcactttcagggagtcttggtggcgatgttgggtctgtagattgtcttgtatgtgagtatgaagtaaagtttggtgggtaataaaaatcctttgtgtcttcagtaacatgaatccaaggaattggatctgcactcttccctagacactgctgaatatactgcccgtctatattatgctgttgctctcgtgaataatagccaatccaaagttcgggattttcaggagagccagcgtcgtcttctttactgtctttgcactggattctagagtcgagacctgagttatgtaggtactgcttcttctctgcagtagttgtatcgcacatctgagattcgcgattcaagcctgtcaaatacagacaaactaacgcttcaggatgcagtctctgcgtttcattcgcgagactcacaaattgcgagaaatcttgaggagttttaagtttcgaacccacaatagaaatcgtacgtatttcgggtcggggggcctgtaagtacgcacgagtcacgcgcgtgcgaatcggagaaaatacagtatctaaagttccctctctttctcccggcttaagttttaaagtttcctcggattttaaacgaccaaaaggacagacaggaaacttcccatgcaccttatcttgattctcaggagttatggtccccctttctctttgcaatatctccgccactcgagatatatgatctcgacctaacgccttctcagtctttacaatctgaacgacatctgaggtaaaggaggacctagtaataatcccggcaacacaggaagaaactaaccactccatccccatgacaatatgtcctacaatagggatggccttgatgacccctaaagcaaaattcgtaaccctagaacaaaagggacgagagaaatcaaacgccttaacaaaatgctgtcgaacggtagaaatccaagaagaaatatagggaattggcataacaacaaaaaaaataaaattagaaacaaacaattttaaataacaacatagaaaatatcaattaaattgaataaacagcttttaaatatttttagtattattttctttaataaactaataaccaactacttttgaagtcctagcttggatttaatatcctcatctaggggtaaaataagaaacagcccttagattcgagcagaaatttcagtcagattctattcaggaaaacctaagattgtttcagagtcaggagaattcgagattctgagggaatttagttttcagggagccctttgcaaggaacttttaaggtatcagacaaacgttactcatcttcgtgcatgtcagtcggagatgctgttgcccctgtagcggtcgaagttgctgttgcatcttcgtcatcatcagaagagcatctttcttgtagagcctgctctaaaggggtaaagtcgacagaaaacttaaagcttttcttggttctctgagatcccaaaatcccgaccatactctgaatatattcctctaagctgactttgatttctcttcctaaagcctgactttcaacataaaataaattgagtttctcttgtgatctccaaccggcctgtttaattacagcgtctaaagtaaataagaagttcttctgtgccacgattttatcacacatataggctctgaaatattctctgaaagaaacactaccttcttctctcaacttgtttgtagaagttctccaattcctgagcccaggatgcatttggattttcgtagactaagactttacatcccgaagcacatgcatccgcggcatcaagagaactggagactaaaatcctatccgaggctaattgtaaactacggatatcttcgctacctaaaggaagatctgtaatcatgacagtaaaggaccgtccttggagatctcgccttagaatctgacgttcctgaaccttggagactccttcggggctcaccgagagaatgtttagatacgaataccctgattctcttaagtcttcttctaatagagacaatgcctctggggacaatccttcttccagaagttttgcatcattacaaacaacagctacgtgcttttctttctcgtcgtgcagaacacgagatagaaactctgaccatctctgtccaaacgaagagttgccaaagtttatagagacagaacggaatgtttcgctagtgagatttttagggtctagaaacgttgacagaagggaacgacgtagctctttgttttgcaaatctaaaagataggaaggacacgagtacggtgaagataaaggcgcgcaaaccctatagggatccagaagccaccctgacagggaattctgaattcctagattcagcttataatgatccttaacagacataaacagagaacaatacgtggagaaggattccagcttattccatcttttctttttacctatttctggggaatgatcgcacggagagagcttctcttgttcttggtattgcacggaaatggaaggggtctcttctagagcaaagtttagaagatgttgtatcacctagggatcttggacttcctgatctttcccgtaacaggtaatcataaaatcgacagtagcgacttctggcactgaaggaagacctgcactcgtaagggatatactctctattttagggtctaaacctagagctcggagttgccctttttcctcttcagaaatttcacagtcccagacatctgccaagttcttcgctaaatagagcttcactttagtatggggatagtgattctgcacgccattagcaagacgcacgaaatttatgaggtccgcagaatctcggagaccaaaacccacaagagcaagatcttgaatcataggtttctctacggacctataggcataggttaacctactacgaacgccttgcagtgcctcatctacagtagagagttcttcatcagggagaagttggacaatttctgtgggtgtgatatctacgaagggatcttctggggttctcccgtgtactttgcctagatcttcttgggaaatggggactctcaagctacttaaataggcttctaggggagctaaacaattatgaccccgtgtttgttctactttaatagcactagagacatcagaagtaaacattccatgacgaacggtgtgtctgggaatccaggaaatcaaccactcgattcccatgacaatgtgtcctaatacgggaattgccttaatgatccccaaagcaaaatttgtaatccgagaacaaacgggatgggtgaaatcaaaggcgtttacaaaatgctgtcgaacgacagtaaaccaagaagaaatacttggacaagccacaatagaaatttatgtataaaaattttaacaaagttattttaatcaaataagacattaaaacaaataagtatctaattatgataataatatttttaaaaacgtttttatttgaaaaataaaaagtcagtgtaaagagttcaagctttcataaaatttttctatacaaaagaatcgtgggatacctaagagaaaaaacctcgataccctctatagacaactagacaataagaaccctcgataccttcaaaaaacccagaatgacctaagaaaaaagaagaatcttcaaaaaagagctctgctggactaataaaaaggttcatcaaaacaaacaccttagaaaggtgtgtctaattagttcccatcaatctgcgatttcgttcacaagattgcgatctttagtcatctgtattgttctcctcagaaggtgcatcttgagctgagtcacaagctgcacacacagcctcgtctaacgtagcaaaactcacattgacattacatgcgacttgaggctgtatagtcccctcaactaagagactgctgccgatataaccttctaaagcacgtcgcatgtcatctcctaaagcctgactttctacagcaaaaagatcccgttttttaaacttccacatggcctgttggattaccgcattgagattgaatacgatgtccttttctaaaactactctcgtagatgctgagacccctaaaggctctcctggaatcccctgacgttgaagatcgcctgccctgtcgatgtttctatagaacgacgcatactgttgcgcccactcttgctcgggatcctcatattctaagatcttacattcagaagcacaggcatcagcagcatcgagagcactagaaactaagatcctatctgacgctagctgcaagttgcggatatccgaactcccttcaggaagatcagtgaggattacagtgaatgacctccccgaaggatcagaacttaaaattctacgttccttaacacacgtgcgttcctgactcactgaaacgatattcaaataagaataacctgactcttccagttcgttctctaatagagataaagaatgtgagggaaaactcttttttataagttgtggattattgcagactacagccacatgcttttctgtttcatcatgtagaacacgagatagaaactcagaccacctctgacccaaaggagagtttccaaagtttatggacataggacgcggatttccctgaccagaattgttgggatctataaaagcggataacaagaaacaacgaagctcttcactttttaaatctaagaggtatgaggggcaggaatactctccagataaaggagccgaaaccctaagaggatctaaaaatactccagaggcaaaatcttccattcccaagtgaacagcatatctatcacatctagggttagacagggtggtatacgtttgaagatgctcctgctcactccaagggatcctctgatcgggtgccgttcctccttgagaaccaggaaagaaatagtagctataaaaaggatcgtcaggtctataggttacagaaatcgcagggatatgttcggaagaaagattgagtagactctttatagagtccacgtctctgacggactgttgtttcccgtaataattaatgagaagatcacaggaaggcaagttctcggattgaagatatttctggagcaggagagcgggggccgacacacatttgattttagcatccaaacctagagagcggagttgctgttctttttcttgagaaatcgtaccgtcacactgattccatatcttttggatagagattaaataaagttttatttgagtttgggggtactgagtttgtatgccgttagccagacgaacgaaattcacctgatcttcgggatctaaaatgtcaaaaccgacgagcgtaagacaagggacttccagaggagtgactcgttgatacgccttggttactcggttgcggattccataaaacgcgcgacctagctctcccagatattgatgaggaaccatattcagattttcttggggagtcctgtcgcaaacataatctctggagaccttcccatggatttttcctaaatctccttcaggaagtcgaaccctaagctgtctcaagtactgttccacccaagcaaggggattataacctcgagttttttctattttcacgatactagcaacgtcagaagtaaatgccggtttcccaaaccttcgtgcagaacatgtggaaactagccaacttacccctataacaacgcatcctaaaatgggaatagccttgatgacccccaaagcaaaatttgtaatccgagaaccaagaggacgtgtaaaatcaaaagccctaataaaatgctgcttaactgtagatatccaaatagaaatatagcatgccataggatcaaaccaacattgaaaatgaaagcgtacgcaggctatataaagatttaaaaaaagatagaaaattaactatcttttaataagaacaacacgatagtttttatataaaaaattgaattctatcgcaactaattaagagtcttcaagatccgaaggatgatcatctgaaggatcctcagaggtagagggaacatcttcatcagaacctgggaagagcgcctctttaagaggagaacagtctgcgataatctctttttgtatgaacgggcctttcgatgttttttcgtgagagtttgtgacatattcaaggtacgatacgatagatggcaagcactgtgttttcaagtctagggcttcacactctttatctatcaagctgggatgtttatgagtccataccgcttgctttatagcggcgtctaacattggaatgaagtgtctcgtgacagtcactcgatcacagaatgctaagaatccttcccagaaggtttttgaagggagcgggagttctccagactctaggatcccttgattcgcctgcgtaatcagtttaaattctcttgagttaaatcctgctgatacgtctacagcatctgcgaaatcggcgtggcgactgaaagttccaggtctccaatttgtatgatcgattttcaagagcttgcatcttgcagcataggcatctacaagatcaaactctctagagaccatgatcctttcagaagcaagttgtaaactacgcatgtctgtatcccctagatataaagcgcaaatcactgtaaaataacgccctgaagttccctctaattccttacggaataaaagctgaggactactatctccgtgacaagaaaatatattgaggtaggagtagtccttagagttcaattcctctactaatttgcagacttgggttgcgggtaaggagagaactcctttaaaaaccacgacgacgttttttcccgtttcatcacgtaagaccatcgagaggaaatctttctgttgtagaggagaaaaagaatctccaacgtttatagagaccttgaggagttctcctgctgagatattctgaggatctaaaaacatcgataatattaaatcctttaaatgttgatccactagatctacaagatacgagtggcaatagtgatcctcagatagaggggcgcagagcattttttcatcgaaaaggaatccgagttcctcttcgagactgaaccatagacacggttggtaatgctcattcccacgagatagaaatgtgtatagctctttagcatcctgcccgactccttgtttcatcatagagtctacgaaagcattcgaggtctcatcaataggaattccgactgtggatatattgactctgggagttctacagtttggagttcccaggagctgctccgttttttcgtagggagaggacagctacgatctgtgtgcacgtagatggagagatcgaagggctcactctctggaacagcatcctcgctgaaaaacccacaacggatgtgcagattttctacatgtaattttgagagtacagcactttgatttacattcttgcccataaagaatcttaaatacatttgcgattcagaatagatacaactcatataagagattagccgctctaggatcttggaactttctgaatcgagaactcctatatagacgatggcaattctatgtaggtcgggttgcctagcacgactgtattctgtagtcacacggttgcgtagtggagcaaatatacgaaataaatttagagctgtcccctcagagaacaactgtaggaacttgagactttggatatcaaaaaaaaggagctgaaggcagatctccgtgaaccttcccctcgtctctaggctctaatgagagcctttgtctctttagaatatcttcaactcgacttctatggtcgtgacccacgacgtgttctactcgcacgatctgatccacatcggaaggaaattctggcttttttatcctagagaggagccagtccagccctacatacaactgcccaataataggaagcaatgcaatcactcccaaagcaaaattagaaattcgtgaacacagggagcgagtaaaatcaaatgctgcttgaaagtgctgttgcaccttcagataccaaagagaaaagtaataactcattaaaaatgagtcttttaaaaaatactttactttaaaaaacagaaaaaatctattattttctaataatcaaaatcagcaaaaatctataggaatagagataagtggctcttatgagtacaagtctccccgatggtcctttgtttttatctctaacagaccctcggtgtttcggaagagttcctagggcatcccctagggatataaggaggctctccgatcccaaacatcacaagctccctaaaggcaaacgaccctgagaaccaaaaactgctctaagcaaagtatgcaaagagcttgatcctctgactacttgccgccattttccaaagtatgatgtacgtttactaaaactcttggactcgcattttattgtgaaaaaaggaaattaaaatcgtcttgtcttaaataagataactttaaactactcataattagacactataaaacaaattatagacaaaaaatctagcattgatttattcagaatatttctttctatttgtgaacgagtatgcgctttttttgcttcggaatgttgcttccttttacttttgtattggctaatgaaggtctccaacttcctttggagacctatattacattaagtcctgaatatcaagcagcccctcaagtagggtttactcataaccaaaatcaagatctcgcaattgtcgggaatcacaatgatttcatcttggactataagtactatcggtcgaatggaggtgctcttacctgtaagaatcttctgatctctgaaaatatagggaatgtcttctttgagaagaatgtctgtcccaattctggcggggcaatttatgctgctcaaaattgcacgatctccaagaatcagaactatgcatttactacaaacttggtctctgacaatcctacagccactgcgggatcactattgggtggagctctctttgccataaattgctctattactaataacctaggacagggaactttcgttgacaatctcgctttaaataaggggggtgccctctatactgagacgaacttatctattaaagacaataaaggcccgatcataatcaagcagaatcgggcactaaattcggacagtttaggaggagggatttatagtgggaactctctaaatatagagggaaattctggagctatacagatcacaagcaactcttcaggatctgggggaggcatattttctacccaaacactcacgatctcctcgaataaaaaactcatagaaatcagtgaaaattccgcgttcgcaaataactatggatcgaacttcaatccaggaggaggaggtcttactaccaccttttgcacgatattgaacaaccgagaaggggtactctttaacaataaccaaagccagagcaacggtggagccattcatgcgaaatctatcattatcaaagaaaatggtcctgtatactttttaaataacactgcaactcggggaggggctctcctcaacttatcagcaggttctggaaacggaagcttcatcttatctgcagataatggagatattatctttaacaataatacggcctccaagcatgccctcaatcctccatacagaaacgccattcactcgactcctaatatgaatctgcaaataggagcccgtcccggctatcgagtgctgttctatgatcccatagaacatgagctcccttcctccttccccatactctttaatttcgaaaccggtcatacaggtacagttttattttcaggggaacatgtacaccagaactttaccgatgaaatgaatttcttttcctatttaaggaacacttcggaactacgtcaaggagtccttgctgttgaagatggtgcggggctggcctgctataagttcttccaacgaggaggcactctacttctaggtcaaggtgcggtgatcacgacagcaggaacgattcccacaccatcctcaacaccaacgacagtaggaagtactataactttaaatcacattgccattgaccttccttctattctttcttttcaagctcaggctccaaaaatttggatttaccccacaaaaacaggatctacctatactgaagattccaacccgacaatcacaatctcaggaactctcaccttacgcaacagcaacaacgaagatccctacgatagtctggatctctcgcactctcttgagaaagttccccttctttatattgtcgatgtcgctgcacaaaaaattaactcttcgcaactggatctatccacattaaattctggcgaacactatgggtatcaaggcatctggtcgacctattgggtagaaactacaacaatcacgaaccctacatctctactaggcgcgaatacaaaacacaagctgctctatgcaaactggtctcctctaggctaccgtcctcatcccgaacgtcgaggagaattcattacgaatgccttgtggcaatcggcatatacggctcttgcaggactccactccctctcctcctgggatgaagagaagggtcatgcagcttccctacaaggcattggtcttctggttcatcaaaaagacaaaaacggttttaagggatttcgtagtcatatgacaggttatagtgctaccaccgaagcaacctcttctcaaagtccgaatttctctttaggatttgctcagttcttctccaaagctaaagaacatgaatctcaaaatagcacgtcctctcaccactatttctctggaatgtgcatagaaaatactctcttcaaagagtggatacgtctatctgtgtctcttgcttatatgtttacctcggaacatacccatacaatgtatcagggtctcctggaagggaactctcagggatctttccacaaccataccttagcaggggctctctcctgtgttttcttacctcaacctcacggcgagtccctgcagatctatccctttattactgccttagccatccgaggaaatcttgctgcgtttcaagaatctggagaccatgctcgggaattttccctacaccgccccctaacggacgtctccctccctgtaggaatccgcgcttcttggaagaaccaccaccgagttcccctagtctggctcacagaaatttcctatcgctctactctctataggcaagatcctgaactccactcgaaattactgattagccaaggtacgtggacgacgcaggccactcctgtgacctacaatgctttagggatcaaagtgaaaaataccatgcaggtgtttcctaaagtcactctctccttagattactctgcggatatttcttcctccacgctgagtcactacttaaacgtggcgagtagaatgagattttaacaataagtgaccaaaacagaaagattaaggaacctctagtgtcaaagactcctcctaagtttttattctatctcgggaatttcacagcctgcatgttcgggatgactcctgcagtgtatagtttacaaacggactcccttgaaaagtttgctttagagagggatgaagagtttcgtacgagctttcctctcttagactctctctccactcttacaggattttctccaataactacgtttgttggaaatagacataattcctctcaagacattgtactttctaactacaagtctattgataacatccttcttctttggacatcggctgggggagctgtgtcctgtaataatttcttattatcaaatgttgaagaccatgccttcttcagtaaaaatctcgcgattgggactggaggcgcgattgcttgccagggagcctgcacaatcacgaagaatagaggaccccttatttttttcagcaatcgaggtcttaacaatgcgagtacaggaggagaaactcgtgggggtgcgattgcctgtaatggagacttcacgatttctcaaaatcaagggactttctactttgtcaacaattccgtcaacaactggggaggagccctctccaccaatggacactgccgcatccaaagcaacagggcacctctactcttttttaacaatacagcccctagtggagggggtgcgcttcgtagtgaaaatacaacgatctctgataacacgcgtcctatttattttaagaacaactgtgggaacaatggcggggccattcaaacaagcgttactgttgcgataaaaaataactccgggtcggtgattttcaataacaacacagcgttatctggttcgataaattcaggaaatggttcaggaggggcgatttatacaacaaacctatccatagacgataaccctggaactattcttttcaataataactactgcattcgcgatggcggagctatctgtacacaatttttgacaatcaaaaatagtggccacgtatatttcaccaacaatcaaggaaactggggaggtgctcttatgctcctacaggacagcacctgcctactcttcgcggaacaaggaaatatcgcatttcaaaataatgaggttttcctcaccacatttggtagatacaacgccatacattgtacaccaaatagcaacttacaacttggagctaataaggggtatacgactgctttttttgatcctatagaacaccaacatccaactacaaatcctctaatctttaatcccaatgcgaaccatcagggaacgatcttattttcttcagcctatatcccagaagcttctgactacgaaaataatttcattagcagctcgaaaaatacctctgaacttcgcaatggtgtcctctctatcgaggatcgtgcgggatggcaattctataagttcactcaaaaaggaggtatccttaaattagggcatgcggcgagtattgcaacaactgccaactctgagactccatcaactagtgtaggctcccaggtcatcattaataaccttgcgattaacctcccctcgatcttagcaaaaggaaaagctcctaccttgtggatccgtcctctacaatctagtgctcctttcacagaggacaataaccctacaattactttatcaggtcctctgacactcttaaatgaggaaaaccgcgatccctacgacagtatagatctctctgagcctttacaaaacattcatcttctttctttatcggatgtaacagcacgtcatatcaataccgataactttcatcctgaaagcttaaatgcgactgagcattacggttatcaaggcatctggtctccttattgggtagagacgataacaacaacaaataacgcttctatagagacggcaaacaccctctacagagctctgtatgccaattggactcccttaggatataaggtcaatcctgaataccaaggagatcttgctacgactcccctatggcaatcctttcatactatgttctctctattaagaagttataatcgaactggtgattctgatatcgagaggcctttcttagaaattcaagggattgccgacggcctctttgttcatcaaaatagcatccccggggctccaggattccgtatccaatctacagggtattccttacaagcatcctccgaaacttctttacatcagaaaatctccttaggttttgcacagttcttcacccgcactaaagaaatcggatcaagcaacaacgtctcggctcacaatacagtctcttcactttatgttgagcttccgtggttccaagaggcctttgcaacatccacagtgttagcgtatggctatggggaccatcacctccacagcctacatccctcacatcaagaacaggcagaagggacgtgttatagccatacattagcagcagctatcggctgttctttcccttggcaacagaaatcctatcttcacctcagcccgttcgttcaggcaattgcaatacgttctcaccaaacagcgttcgaagagattggtgacaatccccgaaagtttgtctctcaaaagcctttctataatctgaccttacctctaggaatccaaggaaaatggcagtcaaaattccacgtacctacagaatggactctagaactttcttaccaaccggtactctatcaacaaaatccccaaatcggtgtcacgctacttgcgagcggaggttcctgggatatcctaggccataactatgttcgcaatgctttagggtacaaagtccacaatcaaactgcgctcttccgttctctcgatctattcttggattaccaaggatcggtctcctcctcgacatctacgcaccatctccaagcaggaagtaccttaaaattctaaaataaaagaacgataaaattgaaatctttagaattaacaactatccgatgagctacgttagcccaatcggtagaggactccctcaaaatttaaatatagaaaatcattcaaatatatgagtttactaactctgtaatattcaacatgttaataagcatatttaaatataaatttataaacttctagacaacaaattgatgattttttatgacaaactctattttcatatcaaagtttggatgtttatgcgacccatttgtctcagcattttatccactgcgctatgttgttccttatcaggaaatgaagtccctaacctcgcctcttgtcagatgtctagaaaagacatctctgctttccacacgtctccaagcttccgtctgaatgtaactccagagcccttggtttcctcctttcgtccctctaatcttcttaatggattcggtcacgatataacccaggacatcacaattacaggaaactctatcaattctgttatagattataactaccactacgaggatggaggcattcttgcatgtaaaaatttgttcatttctgaaaataaaggaaacttaagttttgaaaggaatagctcccacagttctggaggggctctctacagtgttcgggaatgctggatttctaagaatcagaactactcgtttatttcaaatgcggcttccttagctactactacaacttcaggatttggtggggctatacatgcactagatagctatattacaaataacttaggagaaggacaattcttagataatgtctctaaaaatagaggaggagctatctatgttggggtgagtttatcaatcacagacaacttaggtcctatcgttatcaagaaaaatcaaacattagaagattccagctttggaggaggcatcttctgcagagccgtaaatatagaaaggaattatcaaaacatccaaatcaatgataatgcttcaggacaaggggtggtatattttctgccctaggagtcattatctcttcaaataaagaaattatagagatcagcaatcactccgcatcctcaattaacacagcatcaggaaaactatatcccggtggtggcggtatcatgtgtacctccttagtcattgagaacaatcccaaaggtcttatctttaacaataaaacggcagcacttagcggcggagctatacacacgagatctttcatcttccaaaataacggtccgacagcatttattaataactctgcgacttcaggaggggctctcatcaatctttctggtataggaagtactcctcaaaatttcttcctctctgcagactacggcgatattctatttaacaataatacaatcacatcttcttctcctcaacccggatatagaaatgcactctatgctgctccggggattaacttaaaactaggagcaagacagggttataaaattctcttttatgatcctatagatcacgatcagacgacaacagatcctatagtatttaattatgaaccccatcaccttggcaccgtgttgttttccggaatcaatgtagattctaacgcaacaaatccattgaacttcctatcaaaattttctaactcttcacgacttgaaaggggtgtgctcgctattgaagatcgggctgctatttcttgcaaaaccctatcgcaaactgggggcattctacgtttaggaaacgcagcattaatcaggacgaaaggcccgggaagctccataaattttaatgcaatcgcgatcaatcttccttctattttacaatcagaagcctcagctccaaagttctggatttatcctacattaacaggatccacctattctgaagacacttcttctactatcactctctcaggacccttgacttttctaaacgatgaaaatgaaaacccctatgatagcttagatctctctgaacctcgaaaggatatcccccctcctctacctcctcgatgtgactgcaaaaaaaatcgatacttcgaatctcattgtagaagccatgaacttagatgagcactatggatatcagggaatctggtctccctattggatggaaactacgactacaacaagctctacagtaccggaacagaccaatacaaaccacaggcagctctacgtagactggactcctgtaggataccgccctaacccggaacgtcacggagaatttattgctaataccttatggcagtctgcctataacgctctgttaggaatccgcatcttacctccacaaaacctcaaagagcatgaccttgaagcctctctgcaaggactcgggcttctaattaaccaacataatcgcgagggacgcaaaggcttccgaaaccatactacgggctatgcagcaacaacctcagcaaaaactgcagcacgacatagtttctctttaggattcgcacaaatgttctccaaaactagagaacgtcaatctccaagtacgacttcctcccacaactactttgcaggactccgcttcgacagtctcctcttcagggacttcatctctacagggctatccctaggttatagctacggagatcaccatatgctttgccactatacagaaatcttaaaagggtcgtccaaagccttctttaataaccacactttggtagcctctctagactgcacattcttaccagctagaatcacccgcactctcgaactccagccctttatcagtgccattgctctgcgctgttcccaggcctcgttccaagaaactggagaccatataagaaaattccatccaaaacatccccttacagatctttcctctcccataggcttccgttctgaatggaaaacttcacatcatatccccatgctatggactacggaaatatcctacgtacctaccctatacagaaaaaatccagaaatgttcacgacactactcatcagcaatggaacatggacaacacaagcaactcccgtctcctataattccgtagctgcaaaaataaaaaatacttcccaacttttctcaagagtaaccttatccttagattattcagctcaagtctcctcgtcaactgtaggtcaataccttaaagctgagagtcattgcacattttaaccacaaagaaaacatcaaggaataaacagtgcaaaataacagatcccttagtaaatcttccttctttgttggagccttaattttaggtaaaactacaatactccttaatgcgactccgttgtctgactattttgataatcaagcaaatcaactcacaacactcttccctctaattgatactcttactaacatgactccctactctcatagagcaacactttttggagttagggatgacactaaccaagacattgtcctcgatcaccagaattccatagaaagctggttcgaaaacttctctcaagacggcggtgctctctcttgcaaatcacttgccataacgaatacaaaaaaccaaattcttttcctaaatagctttgctattaaaagagctggtgcgatgtatgtgaatggtaatttcgatctttctgagaatcatggttccatcattttctctgggaatttaagctttcctaatgcaagtaatttcgctgatacttgtacagggggagctgttttatgttcgaaaaatgttacaatctcaaaaaatcaaggaaccgcatacttcattaacaacaaggcaaaatcttcaggaggagcaatccaagctgcaatcataaacattaaggacaacactggcccttgcctgttttttaataatgctgcaggcggaacagcggggggcgcgttgttcgctaatgcttgtagaattgagaataattctcagcctatctattttttgaataaccaatcaggtctgggtggtgcaataagagtacatcaagagtgcattcttacaaagaataccggttctgtgatcttcaacaataattttgccatggaagcggacatctctgctaaccattcctctggaggggctatctattgcattagttgttctataaaagacaacccaggaattgcagccttcgataataatactgcagcacgagatggaggtgctatctgtacacaatctctaactatacaagacagtggtcccgtctatttcacaaacaatcagggaacttggggcggcgctatcatgctccgtcaagatggtgcatgcactttatttgctgatcagggagatattattttttataataatagacacttcaaagatactttcagcaatcatgtttctgtaaactgcacgcgtaatgtctcattaacagttggagcaagtcaaggtcattctgctaccttctatgatcccatactacaaagatatactatacaaaactctatccaaaaatttaatcctaatccagaacacctcggaactatcttgttctcctcaacatatattccggatacatcgacttctcgtgatgacttcatttcacatttcagaaaccacattggactgtacaacggcacactcgctcttgaagatcgagcagagtggaaagtctataaatttgatcaatttggtgggactctacggttaggcagtagagctgtgttttctacaacagacgaagaacaaagtagcagtagtgtgggttctgtaattaacatcaataatcttgcaattaaccttccctctatcttaggcaacagagttgctcccaagctatggattcgccccacaggttcatcagcaccctatagcgaagataataaccctataatcaatctctcaggacctttgagcctactggatgacgagaacctagatccctatgatactgcagaccttgcccaacctatcgcagaagttcctcttctgtatctcttagacgtcacagctaaacatattaatacggataatttctaccctgagggtctaaatacaactcaacactacggctaccaaggcgtttggtccccttactggatcgaaacaatcacaacttctgatacctcttctgaagatactgtgaatactttacatcgccagctttatggtgattggacacctacaggatataaggtaaacccagaaaacaaaggagacattgccctatctgccttctggcaatctttccataacttatttgcgacactacgttatcaaacacagcaaggccaaatagcacctacagcttctggagaagctactcgactcttcgtgcatcaaaatagcaacaatgatgcgaaaggattccatatggaagctacgggttattctttgggaacaacctcaaacactgcttctaatcatagctttggtgtaaacttctcccaacttttcagtaatctctacgagagccactccgacaattccgtggcttcgcatacgacaactgtagcgctccagatcaataatccttggctgcaagagagattctctacatctgcatctctagcctacagctacagcaaccaccatatcaaagcatctggatattctggaaaaatacaaacggaaggcaaatgttatagtacgacattaggggcggctctctcttgctctctatctctacaatggcgatcacgacctctccacttcactccttttatccaagcaattgccgttcgttctaatcaaactgcgtttcaagaaagtggagataaagctagaaaattttctgttcataaacccttatataacctgacagtccctctgggaattcagagcgcttgggaatccaagttccgtcttcctacctattggaacatagagcttgcttatcagcctgtcctctaccaacaaaatcctgagatcaacgtgagtctagaatctagtggatcgtcatggctcctatcaggaaccacccttgctcgcaatgccattgcttttaaaggaagaaaccaaatttttatcttccctaaactttcggtgttcttagactatcaaggctcggtatcctcatcaacgacgacacattaccttcacgcaggaacgacctttaagttttaaaagcatgttatatagacaatgcaacctgtaaagaccaaatagagagtagtgaacactctctaccatcatgaatcttatgggagaagctaagggaaatccacagatacgtttcccccataaaaattaagaacccgatacatcctcactagagattcgaaagaactacttaaatcctaagcattcgactctccacgaggccatcctttttgtagtaagattttcgttgtagctacaagtccccctaagggctctagatattctgattctccgtcccccggctctgttggaggaacaatactctctgcttcgaccataacagcactcacgctctcgctaagcaaagcggctcttacttctggtccaaaccctgggctcactctaagcgaaacattagtcaatgtattctcgggtcttggaagtgtagcagggggcctgccatgaatccatgggatctcatcataaataggctctacaggagaagcggaagcaccgcctgacctctcctgtaaaattctatctatatttctctgagtaaatggattatcttcaggagtattagcatatatgggttcatccaagtcgcctctaggagagggggaacggctcatatcttcataatcactttcacctgcacctgaagcaccgctcatatcctcataaatgctcccctcctcactcatagcaggtgaaggaactggaggaagaggcacaccccgtctatttggtgagctgcttcgtacgcgatctgaagacggagaacgtgagcttccagacgatcctggacgtgaaggaagatcatagatagcaggagttgctaatctaggtgtcatgtagatgttcttgtctttagatggttcagcagaggttataggaacttcataatctccaaaaacatcctcttccaactctcgcgcaggactccatctaggggaactaggaacgtcatagattccatcttttctacgaggaacatcatagaaaatatgatcatcttccataacaataaaactgacggaactgtcttgactccaacctctcactatgggagcagaaatcgaaatttccggggtacttgattctgaactctccttggttttagcaccgtgcttatgtgcccatcctactaaggcattcatcaatggagaatcttcacgtggacttccatttctgcgtggaacgtcatgcggagagcccgttctttcagtttcatcaatttctgaaggagaccccaccgacatcgagtcctcttcagaagaagtacactcttctcctcggcacgtgcaacaacgacccactgcttcagcagctgcatgacgagcaatacgcaacctgtgcaagatggaccctagaatgcttaaaatcattcctaaaagagaaaccagagcctcgcgaatctgattccataatcttgtagaccagttttcccgagttctttgaggatctgcagctcctccgatttcctcataaataggctcttcttgagaaatcagagttggattattgtctatcggagttggattatcgtctaaagaaaaactcaatcgagtatgggacaaagcagcttctaaatcgtcggcagtctcatctaataggttttgaagagagtctccatcactcatgagttcttgaagctcaggatctgtcagttctgaacagagggaattgatctcatcactagtttctacccccttaaaacgagcttctgctagagataccgaagattgtgttgcctccatatagccgcattggaattctgtaatttggatcagctgttgtatggtaactgtggcttctgctttttcctctggagtcaactgatcattactttgtatgtcagagagctcctgacgtaaactactcaaacggaggtttagctcgtagagacttaaaggctcgctgtctgtaggtggagccccactaggaagtactatgcgatcgcgaactgtctgtaccaaccgacccaaaccgctctgtttttttactgaaggaagagaaaataaacgctgaggttctggtccagaagaggtttctggaaccccctgagaaggattttcgcctgaaacactcgcgtcctctgccactcgggcttctgtagcagcagcacttgatgaatcgacatcccgtctctcatccgcggtgatggtttttgataatctaacaaaagcttgtcgcgtttcacgcgcttgactcgtagactctgcggaaaaaaagttgccaaatgattttaaggccctgtctaccccagaacgtacgcgagaaaaaaatcccgggctagaagctgccgaagaagagctctgagactcctgatcttctggtagaaaagaggaactgctatgtatatgcgaagatcctgaagctccttcctctccatgttcttgaggaggcagggaaatctcgtggctgccaagttctcccttaggagagggcgatcgacttctatccccattatctttaggtggaatctttcctaatccactagatcctccgattcctgatgccataaacacttcctaaaaagaataatcttttttctgaaacaatttaattttattaaaaaacaacaaaaatgcttttaaatatattaaaataatcaacatattgaagagttttaattaaaactcttcaagtttcccttgcgcatagagaaacagtgagataacgactactgtccctctggagcaaatgatctagctaatcctaagccttgttgaatgacaggatcagtcacattgcctgattccaatttttcaagactctgggcatttctgttactcatttctgcagctctacgagcgatctcttccgcaaaagataagctaggtgcagccgatggatttgaaacgccctcttgctccacaaaccattgtgtattactttctgatgcaagatcatctacagctgattcacgtcgtgctgaacttaatcttgaagcaattgccctaaagaagctcgctaccgcttggaatatgctaactacaaaatcccgtaacgctttccatgctccctgcgctgcagatccctctaccccacctgtttcgggagcttccgcagtctctgctggggcttgcgatccatcttgaggtacgatggatgcatactccacagaatcactacctacattggattctacgaaagtaataagatcctccacagtaggaggttcctgatgagtcaattgctccatgcgtgcaagaagagattgcaccctagaagccacctctggtgacacttgttctggagctactttttccaaattttctaaagccttacgcagatgttttgctgctttattcacattagaaagatcaccttccgatgaagaacgttggaatctagttctgatattccctggtgctgatctgattgcacctgcagcctgctctccgaacgccgaaaccttctctttagcgtcacctaaggctccctgaactgtagacgtcgctcctcgaactcctgataaaaaagaagaactcttcgaagaagcctctgcttcttcggaacgcctttcttttacagtatcgccggcagaatcttcgccctgagttgttaaatcatcttcggaagcagaacgctggaactttcctttaatatcacctagggcaccatgaactttagacaccgctcctcgaactcctgataagaaggaagaactctttgaagaaggctctcctccttcagaacggctatcctctgtagaatcttcattagaatcgtgtcctactcgatcaaggtcaccatcagaataggaacgtttcatcttccctaaatctgcctctggattttcagatcttttctggatacgatctctaaagccctcgagtccaggaagacgttggccatgttgcacatgggatggaagacgtggactagaaacttcaggacgcgcttgaggggtttttttaaagacccctttaacgcctttccaaattctctgaagtaccccagaacgtcctgaagtttgagaatctccgggttctttgacagatggcaaaggaattttatcagtcccgcctaactgggcttttctctcttctattgtagggccctgacttgcaagactactgtcactactgctaactgtatgttcccctaagttgtctttaggacttacttttccatcctcactattccttctattaggaggaatgggggaaggagatcttgagccgcctacgccaccaactgccataattgaaccttaaaatgataaattatttaataaaaactattaaacaaatgttaaaataaaaaatattttaaaaacaaaatataaattaaaataaacaaaaagaatgctgattatataattaagtaaactactagatgtaaaagagaaaataaaattagagaaggcagacaagctcccaaagctcgaggatcttacattcaaggacctggcctaagcagctccatctatatctacatccacatcaataaaatctacgggaccatcaagatcaaatagatgatcgtggctagcagcaagagcctcaacaactaaatccgtagcaatggagcgcattttactttcaggaccatagagaagctcacggcgattacgtcgacgctcatagagcttcacaagctcatcatagagccagttgacaaacttcctcattaaaatcgatcccgcgattcctaacgtcgatcctccaagagcaagaataccaggaacgataggagcaaatgcagggaccagggcaagaagcatgatcccagttcctacaccaagtaagattccaccaacaagggcgctgttcacttccccacccttctcaaaattgcgaacctcttcacgaattgcagcgtcagtcttctgaatctgttttttgtagactgtcttccacatttggttaaattctcgatccgaggcaatcactccagactcaattaagaactggcgcacccgctttttattttttgcttctttccaacgtaatttactgatattcaatcttgctttcagttggtaggcgacgtaggaaaatcctgaggaaaccatagggagtgttacagaagcaaccgccgatcctacagaagcaacaaggagaacttgcatgactgtcaatccaccaaatcccgtgactatgaaggcagcaatacttgctaagagcaagagtgtcgcaagagcaaagatgaccttctgtcttgtcgtcagggaaagcctcgtatcgatttcttccgcagagatcctcgtctctgcaatcccctctgaatctggaacttctatcacagattgggaagtttcactctcttccacctcactggggggcaatttttctaagcgaatgtctttcagggaggtgtctacaaaaagatcttttttttcttgagtaagcagaaaggctctccactttccgatactactatggagtatcgtttgcaaaaccgtcgtaagccctatagaaattaaagggggagctaaaataatagcaatcgttgcgggagcgcctcctagcaataccgttcctgcaatggcaaggagaatccccaaaaccgcaagaccaacgccaatagtggcaattgacaacgtgatatagtgtaattttttcgcctcttttatagtttctgcttctgtaagcttctcccctttagcaactttttcagaacggaaaaacttagtataaatataatgactgaagcttgctaatgtggtttggcttccccgggaatacgcactggatcccaagctacccacgagacccccataccctccaggaacaaaattcgcccccaccttcatgaccaaacccatgacagtaaatccagtccctacagctaaagcacttttgattctgctcgactcctgcatcctgggggacatatagtctcggaccatataaaccaagctcttcattatagaaaatccaccaatacccacgcctgaaatggcgattccaagaagaatagcctgaggaactccgggagctaagacggtcaaagcgacaacaacaacagaaaccgctaccagcaaaacaaccaggccagcaaataaagtcacggaatgggtgaaaatactttttcgcaatcctgtatcttcaggattgctaggaactagggaatttggtactggcgagagactccggctatttgcaagaagagaagttttctcagttgcattagacaaagacaaatatcggggatcgttgctaattggtgatgtagacataaaagaaatactaataattatttttaattataaaataaattattaatatcaactacaccacaaaatagaacaatcccacaacaatttacaaataaagtatttaaatttttagaaaaaagtaactaaatagatcacagtagctaaaggagggagctctatatccaaaccccaagcgaccccttggtcttgacagaccacaggagcccgatttcccttccctgagcctccaaaagactcatcatcagtgttgagaaggagttcacaatgctttacaccttcacaccttaaaacataggaaggaaaagtactcgcactgaaatgatggacacagagaagcgccgaagaacgattgctgcctgcaaatctataataggcaatgacattgttttctatatcatggaagtctacccaatggaagcactcttgagagctctcttgcatccataaatagggttggtgaatatacaacgcattcaatgcagagacacagtttcgcaaagttttgtggtagtgatgattcaaaagctcccaatctaagggacgatcaggagaccactcgccgtattgtccgaattccccacccatgaacagtaactttttcccaggcaaacagatctggtagctcaagagcactctcatttgagcaaatcgggtccaggtatccccgggaagcttattcactaagctgcccttaccgtggaccacctcgtcatgcgagagaggaagaataaaagactcttggaaggcataccaaaggctaaatgtcagatctttctgatggtatttacgatacatgggatccttcataaagtaatgaaaggtatcgtgcatccaacctaagttccatttgtaatcaaaccccagacctccctgatctacgtccttagtgactcctggaaacgctgtggattcctctgcaaaggtgagcactccagagaactccttatgaattacagaatttaagtgtttcaaaaattctatagactctaagttctccttacctccatagatgttaggcgtccattctccatcttcacggccataatcacgatacagcatagaggccacagcatccacacgtaagccatcaatatgcatcttatcgagccaaaataaagcactccctagtaaaaagttggtcacttcatgacgactgtagtcaaaggtaaacgtattccagtggggatgaagagcctgactatgccccgtgtactcgtagagaggctccccatcaaaagaggcaagagcaaacgcatctacgggaaaatgtcccggcacccaatctaaaataataccaatattttctttatgtagatagtctacaaaatactgaaactcctggagagtcccgtatcttgatgttggagcataatatcccgtcacttgatagccccaagattcattcaggggatgctccgtaatgggaagaagctccacatgagtgtagtgcatttccttgcaatagctagcaaggcgatgcgccatttcgctgtagcttaagggccttccctcctgccattgccaagagcctaagtgcacttcatagatcgtgacgggcccttcactctgcttcgagcgcctctccatccaacgatgatcactccaagagtagctctcagaatccgcaacacgagctgtaccctggggtggaggatcaaagctcttcccataaggatctgtttttacaatcacattccccgattgggtaacgatttcccacttataccgtattccctctcccaagcctgggacgaaaagctcccagatcccctgatcggaaattttacgtagaggattgacaaggccatgccaaaaattaaaatctccgactacagagactctctgcgcatggggagcccaaagaacaaagagcacccctgagattccttgaacttccatagggattgcccccatgcgttcataaatgcggtaatgcgttcctctatggaataaaaaagaatcaatttctccccacagaggaggaaacgcatagggatcatgagcgagaagtccattctgatgatacacacggtaatccccgtgtccgattcctttgggaacggataagaaaaagagccccgaacgataagctacagcgtggtgaagctctcctagaagttcaatagcaaccgtatgcgcccctggacgaaaaataacaatatgatctgaagaatcttcagaagcaaggatccctaagagtttatggggatctttctgtcgtcctgagacgagcagatcaagatcccaaggatggatcagtttatcaaccatggaaggctatctatttatgaaaacaatcccataaatatgtggttcctgcttttatctccagagtttctcctaaagaaagtctcttagatccagagagacgtcgctccgaccattcccgaaggcgcgcactgcatagtgaagaacaaaactttaaaaatacctcgccactatattctgcatggagctcgacctgacggatagttttcttagtccagacgatagacaaagtcccaagattaggaagggcaacatgaatcaagcggccacaaggaaattcaggaggtaatgcaggaaggatctctactagctgtccctggtgtctcagaaaaatatcttggatcataccaaagctatacgagagaagctcaaaaggaactcccccctctggatctccatcttgggggaggattccttggaactcttcatcatagctcctaggaagaaagcactctgaaaatcccgcaagggctatggagagtaacgcaggagcaatctctgtagtttccctatgtaaaactctttgatgggcagtctttaccaagctaccgatagccgtcgtctctagatcccgataggatcccttaggagccatagcggcgaaacggaaccataggggaagaatttctttaagatcacgacgacaacggaccttttgccaatctgcatgcttatgcaccccaagagataacaggggccctgcttgcgctgccgaaggcagtttccctttgatagattgtgtgcactctcccgagggaaggagataatacttgtagcgctcagaagtcactgcaagccccccacgatgtaaatcttggaaaacagcaaagcgttttaaaggcccttgcacctgtaaggtctgctcatttaagatttcgtgtttcgaagaaaatagacgccacagggtaggaaatacctgagcatataacaaagatccaggaatagggagtttttgtcctgggaccatagtatagggcttaaaatgttgcattatatctatcatacaatctccccaatcagcccttcttcctctaccctatcaagacgcacagaaactagagtgttgatagctaccgttcctacaacagggaaagaaaccttttcaaaataaggagagtgacccgtagcaacctgccccgttactttctcaacaagcacctctgtagtctctcctaaacgcttcatcatctctttctggcctaccctcttagcaacctcagcaagatacttcttcctctcatagatcacctgattgggaatctgattatcaaaagtatatgccttagtacgacgacgagcactgaaagggaaactatgcactttaataaagcctacatcttcaataattctcaaagtatcttcaaaatcttgatcactctctccaggaaatccgacaatcacatctgtagtaaaggcatagcgaggatcagaagcacggaacttctctacacaatctaaaaaatctccgcgagaatacttccggttcattctctttaaaattgaattcgaccccgattgaagaacaaggtgtgacgaaggacaagtgtgacgcgatgaggtgatggcacggtgcagatcttcagtgatatcatcaggatctatagaggaaattcgaatcctctcaattccaggaatccggtccacctgttcaatcaaagaggctaatgaacgctctccatcgcaataatctccaacattaattcctgcaattacaacttcgcgatatccttggtctacaacccctgcgatttcagctaaaatcttctcagcaggacgagaaaccgaacgcccccgcaaataaggaataatgcagtacgagcaaaaagaattacagccatcttgaactttaataaaagctcgagactttccctcaaaactatggatcttgaactcagggaaggtcgtatcataggaaaaaattttttctataagtcgggatttttctttattggaaacaagtgtgcattgccgatccaaagaagcaaaaaactctttgtcagattcccccaaacaacctgtgacaacaatatgtgctgtagggttctgacgacataactgacgcacagcatgacgacccgaactctcagcagaagctgtgacagcacacgtattgattatgcataaatctgcagggatttcagaatccaggacctcttggtaacctaagatagtcaactggtcgcgatatgcttggacctcatactgattcacccgacagcctaaacagaccagcttaaatgttcctttgacttccgcaaccgtcatatacctctagagacttcaatagatttagcgatgagtggctattttaaaatatcactctttttctcactaacaaagattcgatgtcctagaagaaaactacctaatccccgaaagaactctccaagacgggccctctaccctcgtcatctccacaatcttcagggaaaacataagaaataaaaggacgaaatttcttttgcagctccttaggaagatacgcttcaacaactaaaaaatcttcttgataccttgacgaggccacaaccccggcatcgcaaagttccgtaaattttccatattctgtataaggaaaattcaaagtcacatgcaaacttttctcctgaatgatttccgtcataagactaagaagattctggatcccctccccagtttttgctgaaatcaatacaggaagaggagagagcaaacgtaatttcatagggatacttccttgaggaagccgatctaccttattcaacacagtaatgatcctaggcttttcaatcttcaactcttgaaagagatcgtaggtcgtctgtacatgctctaaagctaaaggatgcgaagcatcgacaacatgcagaagaacatcttcatggaaagctgcttctaaagtacttttaaatgctgctaccaaagtatgaggaagttttcgaatgaagcctacagtatcagtaagaaggacatgacggcctcctggaagtacgcatttgcgcgttttgggatctaaagttgcaaatagcttgtcttcaacatacgtatcagcagccgtcagcaaatttaatagggtgctcttccctgaatttgtataccctatcaaagcaaaggtaggaattcctcgtcgagattttactttacggcgttccgcacgctgtttgatcacagctttcagctgtgctgacagcttatggatacgctcacggaccattctacggtctagctcgatctgtttttctccttcccccttaacaaagcctccgctacctcccccagatttttgccgagataggtgcccccaaagtctcttaagacgaggaaggagataacgtgcttgtgcaagttggacttggatatttgcctctgcagtaagggcacggctggaaaagatttccaaaattaactccgtcctatccaaaacgacaaggccaaggcgtttctctaaattccgttgttgggatggagtgatctcctcatctatgatcaaagtccctatagagggaaactctttcaagatttcttcgatctcctccaacttccccacattgatataggtggaagctgagggtgtttttaaaatccaagaacgggtctctaaaacagaaataccacaggaatccgcaagtgagatcaactcgtctaaatgttcttcaacgacctgagaatctgtcttattttgataggaagccacagctaaagcttgagagggatcctgttccttacgaggcaagtcgaacctggcccctaacgaatttccgaaagattgagaaccctgttccccgggcgtatctatagtgtccaaaggacctccatgccatcataagcaaatgtgacctctggatgctggtcacgctctgcttctaaacagtggctgatatgtgtaataattaaattctttatccctgcatgattcgcaaaagctttggcttcttctacagtaagatgcgaagatttgtgtccctgaaaaggaataggagtttccgatggacccgcagacaagatcaatgtctctacattatctaagtaactgaaaatttttgcatcatagctacagagatctgtaagataagcaagatttccaaaacgaaaacccgttacatggcacgacttttgataataggaaacataagtatagggaatgccctgaaattcctcctgcccacagtcctcattcaagattgtaaactctaaaactgcgggaagtgaagactctacattcggagtggcgaagagatactctttagccttgtttaaaaatctataggtgcttgcagaaaggaccaaaggcaacgaacgctgcgtgactatgtaccacgcacgtaaatcatcaataccaccgatatgatcgtagtggggatgggtcagaaataccccatcgagctcggaaacccctgcaactaacatctgcgtacgaaaatcagggcctgcgtcaatcactagagtcttgttttgatattgaatgagtaccgaagatcgtaaacgatgaatccctgtgttttgacacactctacatgagcaaaacggcacgggaattccttcgggatttcctgtgcctaaaaatactaatttccctatagattcactctgaatatctcttaccataccaattgctcatctggaaacacaagcaaacaaaaataattagtcagtctcttaactttggatcttaaagtcaagaagttgctagaaccccaatttagaatcctctatagctttttaaaccatagtttccaagtatctatccttaaaaattttcgagagggatctcgtgcagcgcagtaaaagattcatgagaaaatgtgagaaataactgacgaacacgcttagttatctctgcgtgatccattaggtaactttgtaatcggttgagataatgcacaggttgcaggatactctgtgatcacagaatagttttgagaatgtgcctgtatctgacgacaatgacattgcgttatatattcgtgtgaaagattgagccactcacggactctccctcttcccaagtacgccatcaagatcgcaaacaagcataaaatggcaccaacccctccaatgatacagggaatcacccaagcacttaatcccgcaatcaaaggggcttcaaccattaccccgacaatcagacctgcaaaaatacacaacccaccaaagacccaactcacaatagagcagatgtcaaaattccttacttgagaacagagctcgtacattgcagactccagctgcggagctcccttacccacgggctccaaagcccataaagaagtaatggggccatgtacgggtaggccttgaaatttatgttgcttacaacgcaagacctgcaagatacctgtaggaggagccccttgcacatcaactacaataacaggaacaacatagggactaacgacctcagcacataactgacaatagaaatacctatttttgtattcttcaatattgccagcaccaggataacatggcaaagaacctaacatgcaatcttgttccttctttgatacaaattcacctagtctcccagagattccccaagaaattctttcatccgattaaagacaggaaaagattcaaataaaggcaatgctcctaaccacattctttggggaacggctgtcaaatacatcaaagctttcaatccttgaaacgacacgccctgtgctgccaagccatgaacaagcataaccgcagcctgttcacttaaaacatctctaggattcaatactttttgtccagactgtaaacgactcgcaaattgagataacatagaatccaagccttgcaaacaaacggtgtaatcggcctgatcttctagagagatttcggtaccgcgaacacagtctagcaaaacagcccaatctatcaaataggataaaggatattcatacaaactgcagaggaaccctgactcattttctaagatttcagtgttcgaaagaatctgctcacgaatctgcctacgatctacccgtaccacagaaccatatttgtcaaagagccgcttcatagcaggaacagaagaagaaaaagcaataaataggttgtctaatctttgatttgcgctctcataacatttttctccctcagcacagttatatccccaatctaaggacattgcgtttatcaaatcgagcttctgaaaatagcgagagagaaatgtttgtatttgtgcttcatagcgggcgacatcgatcgctgtctctgggagctttctttgcaagctctctagatggcgatgtaaaaacttctcaaaaaatgaagacgaccaaatgtaggtaagaaaagaatcctttaagaagcgtctgtcgggattttccaacgccaaaagaagatcgaattgcgccaaagcatcctcaggagaacattcttctctgcgacagctaaataccccgtctgcgtctacactaaaggaacctgaatctgcccaatccatcaaaggagacgttgcttgtaaagcatctccgtagcgaatcaatttcaaaatatcaggagagtaatactgctcttctatcaaaaagagtagaagttcctcggcgtgcgcagtgacttcaggactaagatccactcccagtaagttccactgtctcactaaatgtaaaatgatattgatgtggacacaatctttctttaacagcgaaagtgtcgtagataggggctcaagtttcaatatattttgtaaactctgatcaatatctaaagatcgatccttagaatcaacaatcagagattcgtggagatcccctcgtaagaacaaggaaatcaactcggaacgccaatactcattccctaagacatcttgttgtgtagtccactccttttgcgcaacaatttctggaggagtcgcttctcgactaggttctaaagtcttgcctaaaacgagaccggagacagcaaaaacgatagctaagcttaaaagtaaacatccaagagcaaacccgaggaccacagcccacaatccgacctgtgggaaaatgacaatcatagcaataaaaattaaacagctcaaagcccctaggactaaagctgcgtaatacattcgcgatgttcgttcagtaaatctttcgttggaggagttagcctctcctacagaagtagatgaagttacaggaacagaggttgccataagaataccctctattcgtaagcaacttcagaaagttgccatttcttggttaaagattgaatcaccccttcgctctttaaatctgtaatcgcttgttgaatcgtttgtatttcttcaggacgatctttagctacgccgagaccacagcccaacacccaacattcaggagggagctctaatcttgttgcaacaagattagggaagtctttaagaacgacacgtcctaccgagggttctagaacggcaaccggagatttcccataacgaacttccataatcacctccaaggtgctatcaaaagaacggacacaaattccgggctgagataaaagataatgctcctgaaacgttcctgtctgaacagcaacagaagaatactgtgttaggggaagcacaggggtctctaaagaccgcttagaaaccaccatcagctcttgaacctcatcgccataatagggaagcagggcgatttccttctgacgcgaaggagtaatggacattcctgctaaaattgcatcgatacgatgtttttttaaatttaaaattaaagcatcgaaagcgaattctctaacttccaattgcttgccaagtttttcactaattgcctttgccaaatctatatcgaaacctacaacttccccctgagcatccacatactcaaaaggaggatatgtagcattcgtacctacaatccagatgcgatttcgatcgattttagactcacaacttgttaaagataaaggcattataaaaataaatgctctaaaaaaacggcctatttgttttatcatgaaagtttgcgctctatacgctaaattctatcatgtgttaaagtttacataaaaaaataaatacatcaaactcgaaaaagttttaactttgaataattttgattaaaaaacgagcaatttttgaacgtatgtttccaattcccccaccacattgcccgcccaataacaagaataatttttaccacttaacgactgatactaaagaccctctgttacttagaattctacgtaccataggatacgttctgctccatatcattactcttggtttgcttcttctgattcactactacaagcatcatcgggttgtcagaaaagaaggcttgccaacgcctcccactcttcccaaaggaccagagccaaaaactatagaaattgccaaacaaccgcctaaggatggtgaagacaaaaaacccgatgttcccaagccgggcacgccgcccccagaggacacacccccgcctccccccaaagctccttcaccagcgagcccaaaagtccctaaacaacctgctgataaaaagccgactccaccaccagaggcccctcctcctcccgtacgggtggctacccccatgcctctccgcccatctagtcaaggctattggcaatgcttaaatcgcatggtgagcatggtactaagacgagcgcctctgcctcttcctgccatgcaagttgatccaatacttggcgactttaaccctcatttcgtagcttcctatcccaatcggattgataacgaaccgatgtatttccaaataaaacagttcaagaaaatcgcacaaaatccggatcttcctcaacaacaccggcgacttgcgcaactctctcttgaacaggctctctatctaaatgacaattactaccttgtgaatgtaccgggagatgggaactgcttttatcgtgcctatgctgtaggatggctatctgctctctacgaagagagcagcagaaatgatattgtctttgagcaggaagccacacgtctccttgacctgcctttcgcctcctcttctccggcaaatgcgaatctttgtgcagaaatggctgaactccttcagttatgcagtacttattgctccttcatagacctctatgacggggtgattctttctcagaaacacactgcaactctgatagcctttctaagaaaactctctgcatatgcgattcgccaacaaatcgcagcttcaagtaatgaagaaacagcgagagccttatttatttctgatatgcaggacgatctcctccccagtgttctggaatttcttgctgcaaatcgtccctattcggaattgttccaaaatctcattgatcattccgcacttccttacatgcaatctagagacaaactctttcttctcttggaacatctgcccgctctctttcttactgatgcagagcttcaaaagatgtctccagaagatcaacaacttcgaaagcaatatgaaagagaaatacgagaggcttttgctaagctgagtcgacgcattgctgattcagggtgggatactgagagattcaatgctatagtcaaagatcacctccctgaagcaatccgatgtcaatactctcgctttcttgcaactatagaaaacagacgatctggggatctcccttggtctccagctctttctttctttgcttttctatgtacctgcccctctgtaagatttcacaaactctgcgctactttctacaaatcattagaggatatcattatagcgtccgcgcccccccaacgctctatacaagagatcttacaaataagtaacgcctccctcagctaccttaatgaagatttagattcttcttggcaacgagaggtgatttcttctaacatcatgactatccttacgactcatgagagtttgacgttagagagctctatgcctcaactcgaaacactacataaacgcatagcaaacctattaaagaatgtaatatccacatcctttgaaacccctcctttaagcaatcagccggatttactttcaaatcttgtaaacaagctattagtcgcaattcatagtaagcttgaattaaaagagcacttcaatactgtctgctcggcaagaagtttacgtttaacgcgtgatgaaggcagtggtctctcacaagagcaggacctcctctatacacaggcagtacagctcttattctttattttacagcatcctcaagtgaataatcgtccagaaactaaagatgccgttaaagagttaaaaatgcttctacttccttttctacaatatgcctttaaaaaagtagaaaacgaaaagaaactccaaaaacttctacgttccattctagggtctctagtactcaagcctccagcacgctatccttcaaccccttctaataaagataaagagacgttctgcaagttctggtcacgacatcctgaagtgatggttttagatcccatacttgaaaagaactgtatgcagtttctacgagctactttcccaaattatcaactggaaaccgaggccatactcttagaaaaagaaatcgaaagtacctttaggaatgggtggaacgtttttttaacacggttaaatctcttcggatcaaaactgggttcgccttcttctcccacagctttaagtgatcagttttcgaaatcttttttaatcttttgtttccttaacaactaccctaaacttctacaaaaaaagactccgctagctgctcgattagacgctttccaaagagaggcttctcatagatttacacaagtaaaagataagcttttactttcgttaaaatacggtttccctctagctacagcgactataaatcaatactctagagctcgagatcagttgatttgtaatctcttaaaaaacacggtcacagcatctgatggtttctgtcgctctggttttagacaatcactgataggctacctccactccctaagttctaatgaactcggtgatatcttggatgacgtcaaagagcaagctgaggctaacgacgtcgctgctatgactactgtacctttgcagccgtttgctgtttgtctgatcatgtctgatcgagatactgtctcagaagaaaatattgaaaactttgttgcgatgcatggatttttaaatacaatttctccggaaagagacgctcgtatcttcttaatccgcttccccaaccactacggttgtctcttgcctagaaaccctagaactgaagatcagaactcaaaaccggacagctcaaatccctagttttgcatgaggtacttattcttacgtttacctatcccctaccgcgcaccctcaaacagcatcctgacgaggtccataccgttcctatttctccaaatctatcgtttggagaaggatcgccaatactgatcgcaggcccctgcaccttagaaagttacgagcatacagtctcttcagctcttacagttaaagaagcaggagctcaggtattccgaggatcaatcagaaaaccacggacaagcccattttcgtttcaaggatgggagaaagagtgtgtgctttggcataaggaagcacagagcatccatggtctccctacagaaaccgaagttttagatgtccgagatgttgaaattactgccgaacatgtggatatcctccgtatcggagccaaaaacatgcataacacccctcttttacaagaggtcagcaaatcacatcgtccgattatcctaaaacgcagtccagcagctactcttgaagagtggctatgcgcagcggagtacatccttgcttcttctccctcctgtcctggggtaatcctttgtgaacgaggaattcgtacctttgagcactctacgcgctacacgctagatctcaataccgtggctctccttaaagagatctcttctctccctgtaattgtagatccttcccacgcagcggggaagcgttctctagttcttcctctcgcctctgctggtctctcggtaggtgccgacggtctgatgatcgaagtgcatgcacaccctgaaaaggctctttgtgacgcgaagcaacagatcacgcccgaggagcttcacctatttgctaaaaagcacttctgcccatcagaatcacgggctcatgcgatttcttgaaatcggttgatgattctcaaataaaagagactaaaaaatcttttatttgagaactcttaaattaaacttagccaaatacttttaaaaagtttattagaaattttgttttattatatttaatataaatatttttattgaatagtaaatactattttcactatctaacagccaattggaagaacgccaacacgcgtctttctttggaggtttatgataaaacaagcgtgtaaattttaccttttacagtgtttactttgcgctctgtattggctattaaagtattgcagaaagcttcttaagggcactcttcaccattctgaagagacgctctatcaagccctgctctcctctcttatcgacctgctctatcagttaaaacagcttcccgcccctacgaatgaataataaaaaataaaacgaacccctcttcttcttggaaaagaaggagaggtatcagattctaaacacaacttaaaaaactgacgatctcttactaagcgcaacctatcagatctaagagaaacctaaacaactcaggatctattttagttatatcttctcatgcagtggttatctaagtttgcgttttgactttgtttttccaagtgatctcaataaatcctacaaaggaaaaggcgactagagaacctacccaagccaatagctccccaaacatccccaaagagactatctgaacccatccatagcccagagcaccaacgagcactcctgcccaagcagcagctccgctcacacggcgacctttaggagctagaagatagaaacccacagggactgaaagacaacacactgacaggctatagcttaaaatcaagacatctacgatgtttgtaaaaccaatagcaacaagaggagctgcaaccgccaaacccaatactaaataacgataataaggggctttcaacgtagggtattcttcagcgattagctggcttacagcattcataagagagtccgcggtagagagaatcgcaacgccgatggcagcagccatcacagctgctagtgagggattgcaaaaatatgcaatggtatcaatcagagggcatcctgctttaaggcctgctttagctcctaaagaacctaaaaataaagggataaagttaaaaagaagaagaacaaggcctgcgcctacagccgcccattgcaagcgttttggagaggaggcagccacacacctttgcaccatatcctgctcaacaagcataaagagcataggcatgaatatccaattggaaagcttcgcacaaggaagtgattggaaaggatccaacacagacaaggatttagggacagagagccatacagaaacaccacagacgagcaccgcaataagaagaaatcctgcttggatcacatcagtacgtacgaccccgcgaaaccctcctgttgaggtataggatgctaagacaatccaaaatgctacggttacgtacttgccaaaagggaagctgctaaacaaccgatctaaagcaatcacctgagcgaccaggatgaaaaataaggaacctgcggataataaaaatgcgatcttacggagctttttagaaccataaaacacttcaaagatagagactacggtcgttaacgatccctctgccaaccgcttcccgggccccattcctaagaaaatcaaccctaaagcgactcctaaaggataaagaatccccccataaccataacagaaggcctcttcagcagccccaagaagtacaccgccaccgatttgggtggcaatgaatgtcatcatcaaaggaaagatttttaaactccttcctgcaagaaaatagctctcgcgatcttctacctttttgctaccacgacgtcccacgtacaagcagattccctgaatagctatcaggaaaaataaaaataatgaaaaattcataaaataaagaactccacaacctaaatgaaaaatatttcctttaagcaagctacggtgctgagcttaaagatagaaatgctaggaaaattaggagtggtgatggagataacgtccagaataacgaaatcttaacgagaatagagattcaaaaaacaaatctgattttatatacaggttgtgcatgacatacaggctctgagcttacgctcttcataaattataaaagctaccagataaaaatctataacaaagttttctatctccaaagacttaaaaatgaaagaataaagtcagtctgaaaaattatttttaagaaatagaaattacaactgcgtggtttttcttctatatcttgaataattttattaatatttatttgaaaatagagaaaagagcacccgctgctgcacttcgcagcgaaggagcttcgtgatggcagcagtctagaagaaaaggcacagcatcaagattctcagaaaaagcaacgctctctaagattgctaatttatcttgccaacggctgtcattataaagttgagagaccctctgtagggaagcttgatcttttttctgacatagcgaggctaacgctccttccaactttgctgcaaagcaagcatctgtaaccaaatcctcagaagttttcacatctccctcttcccagaacattccagaaaaaaagctccatccctgagcttgctgtcctgaaaggaacgttgctgttacagccttggcttggctatagcgagctactgccaaaaggcgaatgagcttcctaccaatctcacgtttaatcatatccgaatatagagggaaggtatcaccacgtaaattccattgtgcatcccataagaaatactctatagcccagcacatttcaggattggagaggtagcgagcaatcacatctccagctctttcaatatcttcacggctcacaagaagcaaaatggagaggttcgcagcagcctttcgagaagaaaggctctccaaatgctcctttgccaaagggactccatggattcctaaagagcagagagccgccgaagctgcctcacacacaagaggttgaggagagcgcaagccctcaaccagagagtctctgcccaaagggtctccatgcagatggagaagtgcagcagcttgaaaacgtacttttgcaaatggagaagtgcacatcacatggcgcactttactaagaaactctttgtgattctgtagctgatgactccaagctaaagcagaaagtaagagagactcctgcacttcaggatgctctacagataagagttctgtaaaaatctcagtagtctctggcaacataccgttacgcaacacttcacaagtgaacaacgcttgatcaatatcgtccttagctacacccgtctctagaaattgagaagagagttccaagcaagccttccacgcctctcgacgttctacactatctacaagtttgttctcagcacgctctcttaaaaatggcaatagctcctctatctgtaaaagagcgaccacctgatatgctgtaatccgaacatgaatagaatcatcattacgggcaagctctacaatggccttttttaaactttcagagccatagttcacagcaacctgaagagccaaagatcgaacaatagcactgtcatcattacaactttggagcaggagagggaccaagcgaaaatctctagcaagcccaatagcaaggacactcacagcacgaacggtcacggaaggattttcgattccctcacgcagaacttgaatcccaaattcttctaagacatcgcgatcatgagctaactctggataggaaatctgacacttcttaaaacttctaaaccaatcatcaaaagaagaattttgagccagagcccttaaaactagcttagcctgaagtaaagaatactctttagactccaaaaggcctatgccctcttctgaaacttttgcaaaatcttggatcaacaattgataacggagggactccgagccgaacaaggatccacagaaacaaaagaaaattaggctatagcacctaaaggacgcccacctaaaagatgaatatgtaagtgaaataccgcctgtcctccttcagcaccgttgttgataaccacacgatacccatcggcaattccaaattctgcagcaagctcttgcacgatctttccagcctctgccattaaaatcatctcatcccctgggatatcctgaaatcgtggtataggttttttaggaatgataagaagatgaacaggagcttgaggaaaacgatcttttatagctatgaaattttcgttttcaaataccttttcacaatctatcaatccatcgataatttgtttgaatactgtcatatgatccctcgatcttgtaacgttaaccgcaaagcacgttggcaactttctctatttgtccatacagaaaggaaaagacctttatggcagaacacagccccaggaatccctgatactttggacaactctttacctaacaaacctgcccaattctcagggaaaggaacacgaacgtccatacggcgatctaaattcggaggaatccctcgtaaaatccattgatcgcaggaaggaaaacaaacaaaagctgcagggtgcttctctccccctaaaaaaaagaaattttcttgccatgctaaaggacgatcaaaatataaacacatatcctcggtttccatggcttctctgacaatccccctacaaactcgatcatactgaaacttcttccttagccgacacaaaaagtcgatggtaaaatgcaaagcacaagaaaaatccgcatccgaattagtttcttcttcctcgcgaggattataaattttaataatatcagaaaacgaacaaaatccctccttagagaagaatctgccattatcttgttcatccacaccatgtaccaaagtgttgttaaggaaatgatattcttcacaatccatataaccaaactctttaagataatgcagaatcatacctgcactactccaagatccatcataagagacttgatgatgatcaaaacgcttgttttctatagaataaacaccaccgacatcacaaacatattcacatttcgataatacgacaggatctcgagagcgtataattttattttcatccacaagatcgaaaataataaggagagcacacgctgtgacctcatccgcatggaaagaaccatcgtgagtaccaatgcttcttggaatctgcatacctactatcctccttagccaatcctccattgtaaccagagagaaataattctcaattgcaaagactattctttacattttactcaatctctccaagagaaagtttctgccctattttctaagaaacttttttcctaaaattcccttccacaacacaattttctcgttccaagaccccctccttgacaaattgcacaaaattataacaacaagcagaatgaagtccttgtaggaaattcttctggaaacgctagtcttagaagcgcaaagagggaccttacctattgcttttaactttaaaatacgatgaattatgtataacctactccacgcgcatcatgatgcagcctccccagacggacgactcgtttcccatttgaaaaaactctcgccccacatttacgaaggagaggtcctcattgagaatattcctgcgtactttcttggatttcatctgcctcaacagtgtatacaagtaaatttaaaaagttccttagcccaactaggtgtcgaagccgttttaaaccacttggagctaaataaagcccgaaaagaagctcgtctacacgttctcttcatgagccaagatcctatagccactgctatgttggagctcctagagcctggaagttttgtctgcaagctctttgctgctgatgatcgccgactcgtacgttcgccttgttatctcaacaggatgtttacgcacacagaccgtacaggatctccgctcctacgctttgggaaaaaacttgagcacttcatcactctagagatcattaatgatcggcttgttgtcttccttccgatccttccaggaacaatctgttacgaagagacaatttatgggttccttcccttaatgagcaaatcactcacgcgtccccatttaaaaatacgtaagtttcttcctttgtatcaaatggtaacagatcgtcctcccgttcccgaagatcataaaattcttctcataaagacagagcctctgcacatccgaaccgtatttgcaagagtcgttcaggacttactcccccaagggcttcgtcacaccgcagcggatattctcgaacctaccacacaagaatctggagatatttatgaattctacggcagcacttcagaacctattgagagaatacctttagaattttttactcttgagccttacaaagagcattcgtttttcttctatagagatatgctccaggaaaccttagaatctcctcaagaggtatttcgtgtttttgaatccataccggaaggcgaagatcaagctgcgatgtttatctccaaaggtagtgagctgcttgagctctcccaagactcttggatcatcaaacctcgaatctccccatcagatgaaagacatgctagggaaattcaaaagcacattgaagaccaaccttgtttcccttttttaaaagccatggaaacagatcatatcacaagccaaggagttttattttcccgctacttcccttcagcatcgctgaagggcatgttcctctctaactactctcgctattacctgcaacatatctattttcagattccctctcccacttctggagagtttttctcgaatcgagatcgctctttccttctcgatctatattttgcaggaatttctgtattttgggcagacttagaatcgaaacgactcttacaatacatcaaacgcagaaataaagatgtgggcatgtttgtccctaaacatcaagctgaacagtttgctcaatcctactttataggaattcatggttcctgcctaatcgctggggattatgatgagtttctccgtgagctcctgacaggaatgcatactctttctcagcaattcacgatcccagaatttccaccacagacaccgttagcaatccttacaggagggggttctggagctatggaactcgcgaatcgtgtagctacagaactctccatactctcttgtgggaatctaattagcttggataccacgaatgcctatgtagaagctaaaatgagctatgctattcctgatcttttagaacgtcaggccgacttccatgtcgaccttgctgtatttgttatcggaggcatgggaaccgatttcgaactccttctggagcttattagtctcaaaacagggaaaaaagctcttgttcccgtcttcctaatcggacctgtagactattggaaatccaagatcacagctttgtataattccaatcatgctgtaggaaccattcgaggttctgaatgggtacacaactgcctattctgcctatcctcagcaaaggcaggcattgcaatcttccgcagatatctcaatcatacgctgcccataggacctgaacaccctgtccctgaagatggttttgttatcgtttagaatccataggtaagacggaaaccgtagtaattacacggttcacgaatgaattggccttctttagaaaatccctgatgatattctaaaacagcacggattttccttccgatttcttgaaatttggcccactccatgcctaaaatatagctttgatccaagccaaatttctgttcttcccaacaacggaaatgcatcgcgaaaatcggttgtgcgtggagatttccttctctcagaccaaaaggtctgagttccgcaccccattcacagtaaaacggccgctcaggaaaagtaagatccctacttacaatataaccgcagccgccatacaagcggatctgtggtgtgtaacgaaacgaaatgaagagatcgacgccctcatcactcaaattaaatcttgggaaatttggatgcgtaagaataaactcatctcctaaatgggacgagaggtgccacaatcgaaacctaaaactccatttatctatagcccctgaccagagtccggcaacaaagaaatctgaatttaccatgcacgattcaggatgatctaaatcaaaaactgagaagactcctccttgaattccgaaatcacaatctacatggaatcgagaaacatcaaaaagacgcaggagaataaaatctcccccaaagatggtagcacctacccgattccccacgaccttctcattaaaacgaatgccagcactgttggtaacctgacgaggatctgcaatcaaaggagaaaacaaaatggtattttgaggtaaccataccccttctttgccgcagaaaattggcattcctaaagttttctctttagggagtaagggacgctccgcagaagatctcgttatgcattcaccataaggacgctcgcaaatctccacagcacatatgaagggaagatccctaacaaagttggtaatggcttctgataaactcgaatctacaggcaaagagaaaagatacgctctattcttctcaataacaacttgcgtacggctatctaaaaaatgcatgtccaaaagagactgcacataacctgtaagataacagtcgttttcatagttccagagatgatccggcagctgatccgaacgtaaaacagacttagtttcgtatttgcaatcggggcacaaaggctctcccccagcgatgccacccacaaagagtaccaagaagctaaagagccaacaaaaccaagaatagcaagagtgaaaagctgtcttcatcgtaaagacagtgtatagagaagaaagtatttatttcgcaatattgtatagcaattcttaaaactaagagaccctaactcttttcattgatctttccgatctgtgaagagaggaattcacaacagacctacaaacatctccatgtagaatcagcttgtttccttctagaatctccgttgaaaatccactggtcttctccttatggattccctcccttctaccgcagagacctaaaactctgaaccctcttaatgaagagaaggagggatctcagctctgatccggattagctgtctttccaatggacgtgcttgcctttggggtctttgtttccaggctttttcaagatccctttgggtgtctctataaatgaggtctcagcatcttcttgttttctctctacaccactctgttttggactgcgtgtgtaagttcgcaaacgtatgtaagggtgcgttggagaaaaacttgagggagaacgcttcttgcttccacgtcctgtaaacgttctaatccattgaacaaatctgccaacgaatcctttgcttgtcttcgaatgagaaccttctgtcttggattatttgaaatgggcttctgaaatgcctttgaccttcttctctaaagaagctttccccgtcttagaacccgaggtcaccccaactgaagcactcttatgctttctacgaatcccaccacgacgatgcaagcgagagttccctgaaaggggtacatcctttttcccatcttctggagaaggattcctacccctataacttccataaggattgacccttatcataattacctaaaaaattttttcaaatcttatcctttaattatagtgagcaaattagaaaagatttaaaaaacttttaataaacagaattataaatatatcttaataattaaccgaaactacagagcactccttgcctttatagaggcggttaaagaaaaatcagaaaatggctatccaaaaagctggggctttcttaagatgtcttccaagtgaatcacgcccttacctggagcacgctatgcgtagaaatccccacttttctcttctcaagcctcagtatctattttctgaaattagtaaaaagcttgctcagtttcgcaaggagaatccagaaatctctgtcatagatctttctatcggagatacgacacaacctctctgccgctctattactcaggcaatcaaagagttctgcgtttctcaagagaaacaagagacctatcgtgggtacggcccagaaaccggattagaaaaattacgcacaaaaattgcctctgaagtctatgaaaatagaatctcccctgaagagatttttatttcggatggtgccaaacctgatatcttccgtctcttttctttttttggctcagaaaagactctaggtctacaggatcctgtctatccagcttatagagacattgcccacattacaggaatccgcgacattatccccctagcatgcagaaaagaaactgggtttattccagaacttccgaaccaacaatccctagacattctttgtctatgctatcctaacaaccccacaggaacagttctaacctttcaacaactccaagcacttgtgaactacgcgaatcagcacggaaccgttcttatttttgatgcggcctatagcgcctttgtctcagatcctagcctacctaaaagcatcttcgaaatccctgaagcaaaatattgtgctatagaaatcaactctttctctaaatcattaggctttactggcatgcgccttgcctggaacgtgatccctaaagaactcacctatgacaataacgaacctatgatcaacgattggaaacggctctttgcgactacatttaacggagcatctctcctcatgcaagaagcagggtattacggcctagatttatttccgacacctcccgccatctctttatatctaaccaatgctcagaaacttaaaaaaagcttagaaactgcaggattctcagttcatggtggcgatcatgccccttacctttgggtagaactccctgaaggaatctctgatgaagaagcgtttgatttcttcttacatcagtatcatattgcagtgactcccggccacggttttggttcctgtggacaaggatttgttcgtttctccgctctgacacaaccacaaaatatcgctttagcctgtgaccgcctctgtaccgcttcactaaaagaaacgatggttcttgcatgacaattctacgtaaactctctcagtacttatttttcttttctctgttttgctctttcatctatgtagccacttgtggttctcaaccagatagcgtctcctctcctaaaatcgcaattttcttatcctttccccatcccctattagaagattgcagtaaaagctgtatagaaaccttgaaagattttgagaaccttcctgaaattgttgtcctaaatgctgaagacagtatcgtaaaggctaggaaaattgctcgctccttacataccgataaaaatgtcgtggcgattgtcaccttaggaactattgctacgaaggtcatgagccacattgaaacacagaaacctgtgatctatgccgctgttcctgatcgcgaaagcctaacccttcctaaaaacacaatgaatatctacggagtgaatgacactctagacatcaatcaatactgctttgctatacaagccgtagctaccaatgcacaatctatcgtgtatttaaaaccctccgaacctttcccctcagatctccaaaaagaaattgttaagaaactccatgcttcaggaattgaggtcattgagatctctattacaagcagtacattcaaaacccggatacgccaggctatcgacaagcgcccctcagctatcttcattcccctctccccactttctcataaagaaggcaccgcattccttcaggaaatcctcaaagagaaaatccctatcattaccgacgatacctccttaatttccgaaggagcctgcattgcctgtagcgtggattacaaaaaatcaggaaaacaaatcgcaaaaattgtgcaccacctactctataacaatcacgatgtggacagcctgcgtaaaatcattgctcaacgcctgtcacctacaaccacctttaatgaagatatcatcaagtacttaggaatcaagcttcataaaacagaacgcaaccagttcttatcttttaaaagcaaaaaattggaaaaatctgagaaagggaaaaacgtagctgtgagttaggctatacgtctatatgcaaagaaaaaataatgtcttgaactctgttaggaagaagaaactttttctttcgagaagtttctcctgcaattaaagtgacatcacgcttcggtaaggataaagcttttgctaataaagaaattacagcatcattggccttacccttttctgggggttcggtaacacggaccttcaaagcttgtccatcaaagcctacaattttgttctctttggcttttggagtgactttaacctctaagatccatgaatcatccaaaacaaccctctgaaatatttaagcagccgttcgtttcctttaaccattccgctaaagtatgtagacaaatccttggagcccaatgatacttcaagactccttgagcaaatccaggtccagcaagatcatagctttcccctttgaaaaactgcccgaccctgcaagcatctaaaccgataaagggttgactacttacaaataacacgcgtcccggaaacgcttcttgataagaacggaataaaagtaaggtgtccttacgattcgcaaccacacgattttcctctggctttgctagaagaaatgtcactctgactcctgaagtactatctcgccatgctctaggtaaaagcatttgcatccaaacaaatttggcaatctcttcttcagaagagggagtaactcggttaccagattcccagttctcttcagtagggaaaggattgtaccgagaatcaaagaaatgctcttgttcttcaatagactgatagcgccctcgctctccacatagaaaaacgattttcttaaagcgcacgccacgctgccactctcgcaccaaaaaatctaagcgctgacgtagcgctggcaaaggcccgccaaaaactacagcacaatcatacgttgcagaatacgaaggcacagcctgagtcatatgtaataaagacaaatcgttatagaaagcatgctcatctttaacctgacagatagagactaactctccagaaaaacgttcttcaggagtcagtacccaagcagacgaggactcgattaaatcctcaacattctcagcttcaggaagtccacaaacttctagtaaacgattgactacaggaatatacttatcaatagaacatcttgatttcgcttgtgaccaaggacaacacccaacagaaatgagcgccgtcattgcgaacaatgccactacccatcttgcttttcttctattcataaagggcgccctccttaatcggcaatattagacgccaccatataacaaaaattcaaaaaaacaataaacaaaccaccgcaatttgaactataaaaataggactgggtgagagtaaaagctggcaattctgattcgatagtttctactcagaagagatcattctttattataactccgtctcttcctcactatcagagtcttgcttatcacctcgactaggttggttacggccatctccatggggagattcaggatgtatagactctccctcagctctcacaatcatctcttcctcagataagtcagatcgccgagaaaggcgttctctccttgtagaacgctctccggaagaagacctctggtcttcttgagaagcatcgggattatggaaaggcaaacaccccagcccaggcaaaaggttaatccgtctcactatccacatcaaaacaaacacgatgttgtcatagcaactcgaaataaaacctacaaaattcgcccaaagacgacgtaattcattgagcaatctttcacagcaagacaaactttcttcaaccctaggatcagacgaagattccgttgttccctgaagagtccgcaattcttctacagtaggtagattcactttcttgatctggacaagcatactgtcagcagtaagcaccagtcgcggaatccccctctcacaagaaagagaccaattaccttcagcgtctacatcaagccctaacgaacccagatgctcaagaaccctatcattattgtcaaacgccagggaaagatcttcacgactgagtccctgtagcttgtgatgtacatctgttaacttacttaaaatgagatgagccttcccatgaaactggttcgcatggcctaagacagcctcgtaatcgctacgaaataattccagcctcgctatatccgcattatccccagcacctcgagtttcgagtcttctcgttgaagatttccatgccggaagacagtttttcaactctgactgaaagctagtgaaaagggactgggcacccttaaggtcgtctaaaagctctccaacacgctctacaagtgatgagatctgatcagcaaccgcccgactcgaagaaacttcagctacaatctcgtctaccctcggattactcgccgtttcttcagatgaggtccccacaccttcaggaagagaaagttgagtgactataggaagagccacagcatgcgtggcttgcgcctcatctgaagaaacaacatttttgttttcttccgtagattcaggagaagttacctcttctggattcggggttccagagctttgatttactgacgacatagtactacaattacaaaaataaaagattaataagtatacacttaattataagttgagattattaaatttctaaataaaaacaaaaatataattaaaataatacataatcctgaccccaattgttaagttaagaacccaacgcaaaacattgatctagaaaaatccctgtgttaagatacctccttcatagctaaactaaatctactagcttaaaagactctcgatataaaatcgcaatagcctgtaattttttctatagactcttgacgatcaatcactgaagataacagccccactctatgaaaacgtctcaactcttttataagacttcaaaaaatgcaaataaaagcgctgctgtgctctcaaacgagctcctagaaaaggcaggatacctatttaaagtaagtaaaggagtctatacctatacacccctgttatggcgcgtggtctccaagatgatgaacatcattagagaggaacttaatgcgattggaggtcaagaacttctactcccacttctccacaatgctgaactttggcaacatacagggagatgggaggcatttacttcggaaggactgctctacactctcaaagaccgcgaaggaaaatctcattgcctagctcctacacatgaagaggtcatctgctcttttgttgcacaatggctctcctcaaaaagacaacttcctctccacctttaccaaattgctacaaaattccgagacgagattcgccctcgattcggtctcattcgctctcgagagctccttatggaagacagctataccttctcagactctcccgaacaaatgaacgagcaatatgaaaaactccgctctgcgtatagtaagatctttgatcgtctcggtcttgcctatgtcatcgttacagctgatggagggaaaatcggcaaaggaaagtctgaggaatttcaggtcctttgctctctaggcgaggacacgatctgcgtcagcggttcctatggagctaatattgaggctgctgtctccattcctccacagcatgcctacgatcgcgagtttcttcccgtcgaagaagtggccacccctgggattacaacaatagaagctctagcaaacttcttctctatccccttacataaaattttaaaaacccttgtcgtaaaactctcctactcaaatgaagaaaaattcattgccattggaatgagaggagatcggcaagtcaacctagtgaaggtcgcttccaaactgaatgccgatgatattgctctagcttctgatgaagaaatcgaacgcgttctaggcacagaaaaaggattcatcggtcccctaaactgtcccatagactttttcgcagacgaaacaacgtccccaatgacgaactttgtttgtgcgggcaatgctaaagataagcactacgtaaatgtaaactgggatcgcgacctcctccccccccaatacggtgactttctactcgctgaagagggagacacatgtcctgaaaatcctggccatccttaccgcatttatcaaggcatagaagttgctcatattttcaatctcgggacacgctataccgatagttttgaggtaaacttccaagatgaacacgggcaaacccagcagtgctggatggggacctacggcattggagtcggaagaacattagccgcttgtgtagaacagcttgccgacgaccgtggtattgtttggccaaaagcactcgctcccttctctatcactatcgcctttaacggaggagacactgtatctcaagagcttgcggaaactatttatcatgagctacaaagtcaaggctatgagccccttcttgatgatcgagatgaaagactcggatttaaacttaaagacagtgaccttatcggcattccttataagcttattttaggaaagtcctaccaatcttcgggaatattcgaaattgaatcccgatctggagaaaagtatacagtctccccggaggccttccctacttggtgtcagaatcacttagcctagctctttgatcgctgccctcctcgtaaaaaagttagcattcattcaattcgagtgctaaattctcttgaccttctcgggttcttttcctataatgctctcagttacgattgttctagtaggactcgagatggctagatccaaagtctcaaagcgagattcaaaaatccttgatatcctgtttgctacaacagagttgtacctaaaaacagggcagcctgtagggtctaaaactttaaaggaaagtttttgctctgatttgagtacggcaactataagaaattactttgcagaacttgaagctgaaggattcttaaaaaaaaatcatacttccggaggaagaatccctacagacctagcattacgtcactatgtagatcaccaagaagaatgcccagaagctgagatttctgcccccatttttgataagatcagtcagcttcctagcgaaagtcgcaatattatcaaggatctacaaaaagctacggaacttcttggagaaatcctagacctgcctacgtttttttcttccccacgctttgaaaatgattccgtaaccaatattcaaattacacaggtcgataagcaaagagctgtcaccatcctctctacggagtttggtcagatcttcacagacaccctatggctgcctgaagcttgcgatactctttctatcaaacgtatagaaaaattcctgcagaactacatccgaaagctccccacaaatgaggaactttcgaaaaaagaagaacacctgagcatgtccctctataatgaggtggttgtccgctatctaacacgctactgcaactttagtgaagaagatctctatcaaacaggaatgtcgaaactactgaaatacgaagcgtttaaagatcctgaagttctagctctaggactctctctttttgaaaatcgcagacaaatgtgtgagcttctaaatataggaatgcataaaggaagagctacagcgttcatagggaaggagctttctgatattttagggacctcgaatccaggatgttctgtaattactattccctattatatgaatcgctctccactcggagctttaggtatcctaggcccgatcaatcttccttataaggaagctcttcctttgctcaaactatttgcgaataaaataaatgaaaccctgacacaaagtttctacaaatttaaactatccttcagaagaccactcacctctaactgtaagctttcgaatgagcctattttaagaacggagtactcttctataaaactattaccctctaaggagacgttatgacagataccccacctgaaaatgaggaacaacacgaaagcaatgttcaaaacgaaaatgaagttgaacatttgcaacaggaaatcgtcaccctaaaaaccgaattaaaagaaaaaaacgataagtatctcatggctctagcagaatctgagaattctagaaaacgcttacaaaaagaacgccaagaacttatgcagtatgctttagaaaatactttaatagactttctcaatcccatagaaagcatggagaaagccctcggatttgctacacaaatgtccgacgatgtaaaaaattgggccctcggattcaacatgattctcaaccaattcaaacaaatcttcgaggaaaaaggtattattgaatattcttcaataggccaaaagtttaaccccttcctacacgaagcggtgcaaacagaagagacttctgaagttcctgaggggacgattttagaagagtttgcaaagggatataaaataggagaacgcccgattcgggtagctaaagttaaagtcgctaaagctcctactcccaaagaaaataaagaatagaaataacccctagagattaggtaccaaacatgagtgaacacaaaaaatcaagcaaaattataggtatagacttaggcacaacaaactcctgcgtatctgttatggaaggaggacaagctaaagtaattacatcatccgaaggaacaagaaccacgccatcgatcgttgccttcaaaggtaatgagaaattagtggggattccagcaaaacgtcaagcagtgacaaatccagaaaaaactctcggctctacaaaacgctttattggccgtaagtactctgaagtagcttcggaaatccaaaccgttccttatacagtcacctccggatctaaaggtgatgccgttttcgaagttgatggcaaacaatacactccagaagaaattggcgcacaaatcttaatgaaaatgaaagagacagcagaagcttatctaggcgaaactgtcacagaagcagtgatcaccgtccccgcatacttcaatgattctcaacgagcatccacaaaagatgctggacgcattgcaggtctagatgtaaaacgtatcattccagaacctaccgcagcagctcttgcctacggaatcgataaagtcggtgataaaaaaatcgctgtcttcgaccttggtggaggaacttttgatatctccatcctagaaatcggtgatggcgtcttcgaagttctatctacaaatggagatactctcctcggtggagacgactttgatgaagtcattatcaaatggatgatcgaagaattcaaaaaacaagaaggcattgatcttagcaaagataatatggccttacaaagacttaaagatgctgctgagaaagcaaaaatagaactttcaggagtctcttccacagaaatcaatcagccattcatcacaatggatgcacaaggacctaaacaccttgcattgacactcacacgtgcgcaattcgagaaactcgcagcctctctaatcgaaagaacaaaatctccatgcatcaaagcactcagtgacgcaaaactttccgctaaggatatcgatgatgttctcttagttggaggtatgtcaagaatgcccgcagtgcaagaaactgtaaaagaactcttcggcaaagagcctaataaaggagtcaaccccgacgaagttgttgctattggagccgcaattcaaggtggtgttcttggcggagaagttaaggatgttctacttctagacgttatccccctatctctgggtatcgaaactctaggaggcgtcatgacgactctggtagagagaaatactacaatccctacacagaaaaaacaaatcttctccacagctgctgataaccagcctgcggttaccatcgtagttctccaaggagagcgtcccatggccaaagataacaaggaaatcggaagattcgatcttacagatatccctccggctcctcgaggccatcctcaaatcgaagtctccttcgatatcgatgcaaacggaattttccatgtctcagctaaagatgttgccagcggtaaagaacagaaaattcgtatcgaagcaagctcaggacttcaagaagatgaaatccaaagaatggttcgagatgccgaaattaataaggaagaagataaaaaacgtcgtgaagcttcagatgctaaaaatgaagccgatagcatgatcttcagagccgaaaaagctattaaagattataaggagcaaattcctgaaactttagttaaagaaatcgaagagcgaatcgaaaacgtgcgcaacgcactcaaagatgacgctcctattgaaaaaattaaagaggttactgaagacctaagcaagcatatgcaaaaaattggagagtctatgcaatcgcagtctgcatcagcagcagcatcatcggcagccaatgctaaaggtggacctaacatcaatacagaagatttgaaaaaacatagtttcagtacgaagcctccttcaaataacggttcttcagaagaccatatcgaagaagctgatgtagaaattattgataacgacgataagtaatcaaaattttcaatttaagtttctctattcccatcctcataagaggatgggaaacttccttataaacagaaaacagttccattctcttattctctgatcaaggagttgcaataacagagcttctttagtacaattggctttgaatttgagactgctcctttcataatcacaaaacccacttaaaagggaaaattttgttgagccactcagttcacgagtgaaactacgggatttctcgttcaatgtcctaaacttacaggcggagcccaattgttgaaaaaaccaaaaagaaaaccagggagaagaacatacggtaaatccttgaagatttttattccaggaaccctatttgttcatgctagaaaaggtttcggttttgtttctcccgacaaccccgaagaatacccatttgatatttttgttcccgcccgagatttacgcggggctctagatggtgaccacgtgattgtctccgtgcttccctatccaagagacggacaaaaactcaaaggcactatcagcgaagtactcgcaagaggaaaaacaacactcgtaggaacgatcacctcactagtcagtcccacatcagcacttgcctacacaagcatgtcgggatcccaatctttaattccagtagaactccttcccggacgcacttacaaaatcggcgatcgcattcttctgagcactcctccctgggtagataaaccccaagaaggagcctctccagccttacaaatgctcgaatttattggccacatcaccaacgctaaagcggactttcaggcaattcaagccgaatataaccttgccgaagaattccccccagaggtcattgaagaagcaagccttttctctcaaaaacacattacccaagttctccactctcgcaaagatctccgtgatctcctctgtttcaccatagactcttccacagccagagacttcgacgatgccatctccctcacctacgatcataataacaattacattcttggtgtacacatcgcagacgtctcccactacgttaccccacattctcacctagacaaagaagctgctaaacgctgtaactctacatatttcccagggaaagtcattcccatgttgccatcagcactctctgataatctctgcagcttaaaaccaaacgttgatagactcgctgtatccgtatttatgacgtttacaaaatcaggtcatctttcagattaccagattttccgtagcgtcattcgaagcaaatatcgtatgacctacgatgaagtcgataacatcattgaaaagaaacactcccaccccctctcaaaaatcctcaatgagatggccactctaagtaaaaagttttccgatatccgtgaagaacgtggttgcattcgctttgtcctcccctcagtcactatgtccttggataatcttcaagaacccgtagctctgatagaaaaccaccagaccttctcccataaactcatcgaagagtttatgcttaaagcaaacgaagtggtcgcctatcatatctcccatcaaggcgtttctctaccttttcgtagtcacgaacctcccaatgatgaaaacctactcgccttccaagaattggcaaaaaacatgggctttgatatcacgttcactcccacacaagaacctgattaccaataccttttgcaaactacgtcagcaggacatcccctagagcaagttctacactcgcagtttgtccgaagtatgaaaacagcctcctactctacagaaaataaaggtcattacggacttaagctcgactactacacccactttacgagtcccatacgtagatatatcgatcttattgttcacaggcttctcttcaaccccctatctatagaccaaacgcacctcgaaattatcgtaagagcatgctctacaaaagaacgagtatccgcaaaagcagaaaattctttcgaaaacctcaaaaaaactcggttcataaataaatttttgcaagagcaacctaaaactacataccatgcgtatatcatcactgcaaatcatgaaggactctcatttgtagtgaccgaattctgccatgaagggttcattgcagcagcagaactccctaaagaatattccctaaagaaaaacgctcttccagaatctatcccagataaaatgaaacctggagcttctataaaagtcactattgattccgtgaatctccttacgcaaaaaatcgtctggtctatagcgacaaccacagaagataaacctaagaaaataaagaaaacgccttctaagaaaaaaggaacgaaaaaaagagcctcgtaacgtgctacaagaacatttttttctatcggaagatgtaattacactagcgcaacagcttttaggacataaactcatcacaacacatgagggtctgataacttcaggttacattgtagaaaccgaagcgtatcgtggccctgatgacaaagcatgccacgcctacaactacagaaaaactcagaggaacagagcgatgtacctgaaaggaggctctgcttacctctaccgttgctatggcatgcatcacctattgaatgttgtcactggacctgaggacattccccatgccgtcctgatccgggccatccttcctgatcaaggcaaagaacttatgatccaacgccgccaatggagagataaacccccacaccttctcaccaatggacccggaaaagtgtgccaagctctaggaatctctttggaaaacaataggcaacgcctaaataccccagctctctatatcagcaaagaaaaaatctctgggactctaacagcaactgcccggatcggcatcgattatgctcaagagtatcgtgatgtcccatggagatttctcctatccccagaagattcgggaaaagttttatcttaaataatcttaagctgtatagtaaagaaacaaatgcccatttcctcatatcttgcaggagaatcatgaaaaaatactttattacaggacttgttattctccttcctctagcaattactattgctattgttactatgatcatgaacttcctaacccaacccttcgtaggcttggcttcggaattctttgagaaatttagcttttatactaaacatagagctcttctaaaattcgtattgcaaatcattttactcttcggtctctttttcgccacagtgctcctaggtttcctcacgagaattatgatttttaaatccctactctctatctacgacaaaatcttacaccgaattcccatcattaaaacagtgtataaagctgcgcaacaagtcatgactaccatatttggatcaaaatcaggatccttcaaacaagtagttatggttcctttccctaacgcaaatgttcaatgcatcggtctcgtcgctggagacgcacccacagtatgctgcacaggagaaaaggaagacgaccccctcgtcacggtcttcatcccaacaacacccaaccccacctcagggtttcttaccctatttagaaaatctgatatcgtattcctagatatgaaaatcgaagatgctttcaaatatattatctcctgtggagtcctctcaacccccatggcatgcccctcgtctcccctccctgacgagctacaccaagatcaaggcagctaaaagacgtcatcttcttgaaaaaaaactcttcttttactatcctttttcttataaagtactccgtatcctcaatttccgttgtctggagaaattaaaaaattcaatatcgagttatttatgacacgaatgagtaaacaagctcggcgcagagcgaaaagtcctaaaaaacgtaaacctaagtatgccattgtgcatccagcgccagctccaagaattgtatataaattgcatacgaatgcattgagcaccagtgatagcatttttatcccgaaaataggttaatttctagagtagaattatgtctcgacatcgtagttatggtaaatctgtcaaaggggttaccaaaagaaatgttttgaagcgttttgagcgagtagaagtcttgcgtaagttgggccgttggaatgatagtacagcgaaaaaagtcacaggtttacctaagacccctattttaaaataagtttgtttttctctatgggaatttcattcgcgtgacgcaagaaaagatcaaaatacatgtttccaatgagcaaacatgtattcctattcatttggtttctgtagagaagctggttcttacgctcttagagcacttaaaagtaacaactaatgaaatttttatctacttcctagaagataaagctcttgcagaactccatgataaggtatttgctgatccttctctaacagatacgatcactctgcctattgatgctcccggagatcccgcttatcctcatgttttaggagaagcattcattagcccacaggccgctcttaggtttttagagaacacatccccaaaccaagaggatatctacgaagaaatctcgagatacctcgtccactctattctccatatgctcggatacgacgacacctcatcagaagaaaagagaaaaatgagagttaaagaaaatcaaatcctgtgtatgttaagaaaaaaacatgctttgctaacagcttaacatgctccatattcttttagccatattctgtattcttctattcctagccttcgggcttacgcaaccgtcctgtcacggatcctcaaaattcctaaaaaccctaaaccaacgcttcttcaaagataaaggaagagagtatccccccttccccagtgctcctacaattctcgccacgctgctctgcatcctctatggagctctcgggacaaaactctataccctcctccctccaaaaacagctcacaaagatctcctattctggcccctatactctctaagcgccctgatagcttacggattcctccccccatggatctctacaaaagtccctaaagaaaccaccgcccacctccgttttctagcttcggtattccaactcggtctcttcccactgcaactgctcttttacagacgccgccctaaccaacaagtacgatcttcaacatcatttcaaagccagctctccgaagccctctccgcttttgataacctcattgtccgtgaagtcatgatcccaaaagtagatattttcgcacttcccgaagaaactacactacaagaagctctggttctcgtaagcgaagaaggctacagtcgcgttcccgtttataaaaaaaacttagacaacatcacaggaatccttcttgttaaagatctcttactgctctatacaagcagccacgacctcagccaacccatatcctcagtagcaaaacccccattctatgccccagaaataaaaaaagcctcctctcttctccaagagttccgacaaaaacatcgccatctagccatcatagtcaatgaatacggattcacagaaggcatcgctaccatggaagatattatcgaagaaattataggagagatcgcagacgagcacgacgtacaagaaaatactccttataagaaaatcggaagctcttggattgtagatggaagaatgaatatctccgacgctgaagagtacttcaatttgaaaatcgatcatgaaaatagctacgatacactaggaggacatgtcttccataaagtgggtgctgttccccaaaaaggaatgcgtatccatcacgaaaacttcgatatagaaatcattacctgcacagaacgaaatgtcggaaaactaaaaatcacaccaagaaaacgtaaattcaatatctcctaagaatgtaaacatcctaggaccgatttccttgcactccacgatcccatcctgcctccccccaatcgaaattctcaaacatcaccaataaaaatctctttgcaaaaaagctaaagatttatcagagtgaaaacttaagctcccgtatagttaggagaactatctagatgagtgatatccaaaaagaagaacacggctcaacaacaatctttcatctccacggaaaacttgatggaatttcttctccagaagtacaagaaaatatttcccaatccctagcagctggatccaaaaatatcattctcgactgtgctcacctcgattacatgtccagtgcaggtatccgagtcctactgcaaagctaccatcaagtaggacaacattctgggaaaattgtcctgactacagtcccaaaaaccatagaacaaactctctatgttacaggattcctttcttactttaaaatattcaatactgtggatgaagcgatacaaacactaaacaaagacggggattgagaaaaacctcactgttagtatatgatggcgcttttaagtcatataaagcctccctcttactatgcgacgatctgtttgttacgttaacccttcgatagctcgagcagggcaaatttctacttggaaatttctttattcccttgccacaccactaccagctggaaccaaatgtaaatttgacttagcaggaagtgggaaacccacagattgggaagcccccgcgacagatctctcccaaactagaaacgtaatctacgcagaaatgccagaaggcgaaatcatcgaagcaaccgccattcctgtaaaagacaatcccgttccacaattcgagtttactctcccctacgaacttcaagtaggagaaaccctcactattgtcatgggagcctctccaaaccatcctcaagtcgatgatgctgggaacggagcccaacttttcgcacaacgtcgcaaacccttttacctctacatcgatcctacaggagaaggaaactatgatgaacccgatgtcttctctatggatatccgcggaaacgtcctaaaaaaaatagagatctttactccctcctatgtcgttaaaaacaaacgcttcgatatcaccgtgcgatttgaagacgaattcgggaacctcaccaacttctctcctgaagagacccgaatcgagctttcctacgagcatcttagagaaaatttaaattggcagctcttcatcccagaaacaggctttgttattcttcctaatctctatttcaatgagcctggaatttatcgcatccaattgaaaaacctctctacacaagaaattttcatctctgcccctatcaaatgtttcgctgactccgccccgaatcttatgtggggtctcctccacggcgaatccgaacgcgtcgactctgaagaaaatattgaaacttgtatgcgttatttccgagatgaccgcgctctgaatttctatgcttcttcatcattcgaaaatcaagagaacctctctccagatatttggaagctcatcaatcaaactgtctccgactttaatgaagaagatcgcttcatcacactatccggattccaatatagcggagaacctcatctcgagggagtgcgtcacatccttcataccaaggaaacaaagtcccactcgaaacacaaagaatacaaacatattcccctcgccaagctctataaaagcactgtcaaccacgacatgatttctattccttcgttcacagcttctaaagaacatggttttgactttgagaatttctaccccgagttcgaaagagttgtagaaatttataatgcctggggatcttcagaaaccacagccgctctaaacaaccccttccctatccaaggtaaagatagcgaagatcctcgaggtacagtaattgaaggattaaagaagaatctccgcttcggatttgttgctgggggtctcgacgatcgaggaatttataaagactactttgactctccgcaagtgcaatattccccagggttgacggctatcatttgtaataaatatacccgagagtctcttgttgaagctttattcgcacgtcattgctacgctacaacaggacctaggatcgtcttaagcttcaacatcacttcagcccctatgggctccgaactctccacagggtcgaaacctggactcaacgtcaaccgtcacatctctggtcatgtggcaggcactgccctactcaagactgtagaaatcatccgcaatggcgaagttctccataccttcttccccgatagcaataacctggactatgaatacgatgatatggtacccctaagttcagtgaccctaaaagatccaaacggtaaagcaccttttgtattctactatctcagggtcactcaggcagacaatgctatggcctggagttccccaatctgggtggatttaaattaagaaactatcctatctaaggatttcttatgatgacactttttctcgtaatctgctgtgccacagtattgttaggtctagggatgggtattctacttgtaggttcccatttgcttggcaggcccctctctaaagggtgtcaaaaaccagattgctgccaaaaaaaaacatgtgacaaaacagagcactgtgctacaaaatctcgagagaatagtacatcaaagtgttcatcaaatgacgacgtgcctcccacagccccctaaaacttcccccctctactccatattcgaaaaactggatgcccaagaacgattaagcagtgaagacgctcttcatctcctcctcctcacgaataaagaagatcaacgcacactctggaattttgcagaccaagttcgcaaacaacgggttggcgacactgtatactactcctcaaccttgtacctctatcctacaaatttctgtgacttcagctgcaaattttgctctttctatgcaaaacctggagaccctaaaggatggctctactccccagatgatcttctacagcaaatccaaaatataaaaactccaattacagaagtacatatcgtgggaggctgtttcccctcctgcaatctgcaatactattccgatctatttactaaaatcaaagagtacgatcctcagatccatatcaaagctcttactgccattgaatatgcctatctctcagatcttgataacctttctattcgcgatgttcttctcacattaaaagatgcgggtcttgattccatccccggaggaggagctgaaatcctcgtcgacaaaatacgtaatttcttagctcccaaacgcctttcttcttctgattttctcaacatccataagatggctcatcaactgggaatccatagcaatataaccatgctctgctatcataaagaaggacctgaagacctcgtcacccacatggtaaaagtccgcgacttacaagacgaaactcagggctttaaaaacttcatacttctaaaattcgcccaagaaaataatgtcctaggaaaaagattaagaaaatcaggccagggtcatgccatccctctaaaatctttaatggcagtagcccgaatcttcttagacaacttttccaatatgaaagccttatggaattacctaggtattgaggcagctctagacctcctttcctgtggtgctaatgacctttcttcaacacatatgggggaaaaggttttccagatggcctcatctaaagaacctattaaaatggacgctgagggaatggcggccctcatcacacaacaagggagaacgccatgtctaaccaactccagccatgtataagcttaggctgcgtaagttatattaattcctttccgctgtccctacaactcataaaaagaaacgatattcgctgtgttcttgctccccctgcagacctcctcaacttgctaatcgaagggaaactcgatgttgctttgacctcatccctaggagctatctctcataacttggggtatgtccccggctttggaattgcagcaaaccaacgtatcctcagtgtaaacctctatgcagctcccactttctttaactcaccgcaacctcggattgccgcaactttagaaagtcgctcctctataggactcttaaaagtgctttgtcgtcatctctggcgcatcccaactcctcatatcctaagattcataactacaaaagtactcagacaaacccctgaaaattatgatggcctcctcctaatcggagatgcagcgctacaacatcctgtacttcctggatttgtaacctatgaccttgcctcggggtggtatgatcttacaaagctaccttttgtatttgctcttcttctacacagcacctcttggaaagaacatcccctacccaaccttgcgatggaagaagccctccaacagttcgaatcttcacccgaagaagtccttaaagaagctcatcaacatacaggtctgcccccttctcttcttcaagaatactatgccctatgccagtaccgtctaggagaagaacactacgaaagctttgaaaaattccgggaatattatggaaccctctaccaacaagcccgactgtaaaaagatcttcgattccatagcgagtaagtatgatcgcacaaatacaatactctctttaggaatgcaccatttctggaatcgctctttgatccagatcctagggtcgggatactctctcctggatctctgcgcaggaacaggaaaagtcgcgaagcgttatattgccgcacaccctcaagcatcagtaactctcgtcgacttttcctcagcaatgctcgacattgcaaaacaacaccttccccagggctcttgctcttttattcatagcgatattaatcaactgcccttggagaatcattcttatcccctagcagcgatggcctatggcctcaggaacctctcggatccacataaagccctacaagaaatctcccgagtgcttatgccttctggaaaactgggcattctagagctcacacctccaaaaaaaacacaccctacctatagtgcccataagctctatttgcgtgctgtcgtcccctggattggaaagtctgtttctaaagatcccgacgcctatagctatctcagcaaaagtatccagcaacttccaaaggaccacgatcttgaagacctattctctaaatcaggattttatattgcgaaaaagaaaaaattgttcctaggagcggctacgatttggctactagagaaacaataaaacatggaggatctccaagcttggtcgcaaggagctccctaagattcgtggagtgctctaccccacgctaaactaaaatggtaaacctacctctgggaagactctcatcagcaaaactcccgacaagcttcgtcctgacacaactcttaaatcgctgttttagcatagcagtcttgctaggttcgttatcgataataaaagcaccctcttcatccgaagactcaaagaactgcataatctcaccagaagcaactaaactctccaaaagctctacaagctcggtacgtctttcaccaactcctctaaggacaaatctcccaaacggctgattctcccaatatccagaaatacgtccagcctgcaccagaccctcgagtaccgaccgaatctctccagcttgatcaggatggtcataccaaccttcgattccaggctctaggacccgtagccccttaaagagaatctcctcatcagaggccaccaaaaattccgttaagatgttatttttaggcttagactcgaattccgatttaaagaggtctagttttgacgtaggaagaggtttagctgtacagctcctccctacgttaaagctttgcaagagccatgccactaaagaattgaatactttaatacgtgcttgtgactgagttgccgccagccctcgggcaagaatcatattccctaactctttgtttaagaaaatttcttctaatccttctttctttgttttaaagaaaaatttatagagcctctccgaccaacgccaattcgtacgccaattctcaggtaaatcaggaacgtgtttctgtatttcatccttagaaagttcataatcagctaaatagccattatacaagtccaactccatacgacgcgcacgagtagcttctaaaatcagacttttttcttcatctgtaaacatcacctcaggttctttaggcggctctggatagggaacattttgaactacaagcgcatacctcagagaaaaactcggctcctcctctgtccctggtgtagaatccacggcagcctcagccgccgcagcctctgaaaccccagatgtggtgtctgtagttcccgaagctgcaggcatggtatctgttgtattccctggagctacaggtgaagactctacagtctcggaagctgcaggtatctcttgagtaggattggcgttcacaggaaccatttccgaatccacaataacagcgtccttactacctaaacttttaggaaactttaggcgcttcattgtttcttctaaccaaactagctgctcctcagaaccaaggataggggcccactggaccaaagtactacatagccggccgtgggctggagaaatttgagaaacttgtggctcaagagaacgtatcccaatagcgggcccagcctcctcataatcacttttcacagagaggttatcccactgcaaagcaaaaggacgcctttgaagaatacataattttaatatgtcatccaatcccgaaattatagaaaaattccttttagcaaactccttacccttcgcaccggaagtgtgctgcgggacaaagaaaggccctatgggcaagcgctcattaggaactaaagtagggaagtcacagagcccccttgccaccatacatacgtaataggccttcgcgatagccctccccaggacggctaggataatcttcacgaaccatgacactcggaatgatatcgatattcttcaatcccattttctctataatcaacttagagtggatcaaccggtagcaatctaccatagcaaaatgggcgtcgtaatcagagcggaaagcctcacaaatcgtattgccttccttagtcctcagcgatgacccttgtttttcaataacaaagcacaaagaactgacgtgaggcctaaaatcccgaatcaaacaggcccaatccaccaaaggctcgttcggtggctcagggctgaaatgctccataaataggaaaattttagcagctaaggcatggttaagaccatggttctgaaatggagagaataacgtccttactataggaatctcgcctgtgcctaaagatgatcgtcctaaatcccaatggcggaccccctcgtagtaaacggagcgagcgggcttgtgaatctcaaaagctctcttattttgccggtaactcgtaacagtgctataagtaagataacttataattgcaacgtcaccaagaagtgacatcacaaaaagaattaaccccattaccgtaaaagaggtcgccaaggccataatgcttggaatcaaactagagagggccacacaaaccaaaatgatcaacaatgcgcataaaaagatgacacttgcccgaactagacgtgtgctcaactgattctgactcgtatcctcaagatacgtctttaagctacaggtaacccgagtcggctctattcttccgcagctcagtagtgatgacatgatgaactattcactgtttcttaaattagctttaaaaattttaacagttttttaattaaaaaaatgactaataataaatagctattgttaaaattttaacaaaacaataaatagaaataagaaagatttgtaataagatcatgtaaagaagcaataagaacagcgtctaaaaataaactacttcacaaaatagaagattaagaagattttttgcggcctcgcttgctccccttcgtcttagtgaccactttctcatcatcatcaccaaagaaatctccagtagaaagagagtcgtaaccaagcttagccgaaagctctttaagagaagcaaacctctctgaaagattggtaagattcagctggtcttcaacacgagtcgaaccgcgcaagttagcaagaaattcttcttccgtatcaaatttttctgagaaagtaattgaagagggtgaagtaatctcgggtaagaaaaggaaacgacgagcagcctgagggacttttgtataaatatcactcgaaattgttgtttctgtttctaccttagcagattgcttcggaggacggcctcgtttcggacgagggtttaatgcttcattggaatagtaaatcttagctttgttcgacaacaactgacgcgcttgagtgatttctttccccaccttggcatcaaacaaatgtattttcaactgttccaaaacattctttgtgaaatctagatcttcttcaaagacaaaatggaacttattattgcgaagccattctataattcgaattcgagaacgctctacataaaattgctgccacttttctaactctgcctcgtgatcataaataaactctaaaaactgctcacgggcattcttggattgcaaaatctcaaggaacttttctttggtatcgatatcataaatcttttcattgataaacgtttccatgattttttttacttcataaaacgtcaacttcggaatcaaacaataccgctcggcattctcttctaattcttggtaaatcttatttagatcctcttggtctttatctaaatctatgtagagaataaacccttcaacacgatctaaataaaagtccctctcatcgtcagacttagagaatgcatccataagacgaaggattcttaaaagaagtgggttttgtggtacaggatacgtcatcataaattacgattatagaaaaatcccagttagagagcaagatctatccctaaacaagattttaaaatccttgcatgacaaaatcaaaaatcacatctaattataaatctctagttacagagccctgaagatatacccgtcccctattttgactcacagtcataagctctccaccccaagtatggatttggatcgactccttccatccataggagtttgacacaacaagagcagaagctagagcccctgttccacaagctgcagtttccccttcgactccacgttcgtaagtacgaacgcgcaactggcaatgtcccagtatctgaacaaaattgacattcaccccatctggagagaaggtctgatgatagcgaagaaaaggacctaagatagaaagatctaaagtagaaatctcaggaagaattacgacagcatgaggcactcccgtatggatacaaacgacctctttgggaagaggatcaggacgcgactccaatcgatgaacagaagctctccaatctgcgagagtcatatctacaagcacacgatcccaagaataaaaatatcctgaatatagaccactatccgtagatacagagatgtccgattttcccttctgagaagctaagtgagcaatcgcacaacgcaagccgttaccacacatcgttggacgtgatccatcggaattaaaaataatgagttgcgcatcagcacaagaagagggctttaaatataaaaaaccatcaaccctcgtctcttggcataagaaccgaacatcttcaacctcaggaagtgtttcaccaagaaggaaacgatttcctgctccagaatagataaaatatttagagatcgttgaaggagaataaaatgccatccaataaaccaaaatccttagcttcgttggctgtcatccacatatctctatcgatagccttttctatgatatctcgaggttgatttgtcgcctctacatagacatctataatgcgagcttttgtttttaaaatctctctcgcatgaatgtctaaatcggttgcctgaccggtaatcggtccacctattgaaggttgatgaatcataattctagaatgaggagttgcaaatctccttccaggagctgcacataaactcaataccgagcccatagaagctgccaaccctgtcacaacagtagtgacgggtgaggttaacattttaatttgatcccaaacagcaaaacctgcgtccacagatcccccaggactattgatcacaaaaactataggctttccaggatcttttaattccaaataccaaagctttttaattgcatcggaagcacttttctctgttacaggctctgagaaaaatactctgcgcgcttccaataactctttttctataatatcacgtaatttatgaacttccccgtctgccataaaataatgtctctcctaactaaactaaagcttctaaatcaatttcagggtagagcgggaaacgcagcaacaagttgcgaacacgatctctagcttcctgcgctatggcttcaggaagttcccctttatttttcttagaactcccttcaacatggcaacttaaacgaatatttcgcaatactttcacaataatatctgcaacttcttccatttcatcgatacccatacccaaagtcgttagtgcaggggttcctaaacgtatacctgaagtgtcccacttaccaatagcatctgaaggtaatgaattccgattcacagcaattcctacggaactcaagatatcttcagcaatttttccagaaatgcccaaagaacctaaatcaatcaccatcatgtggttgtctgttcctcccgtcaaaagacgtagcccatgacttaaaaatctctctgctaatcgacgagcattatttacaacctgatgagcgtatttcttgaaatccacagagagagcttccttcaaagccactgttttagcagctatcacgtgaggtagaggacctcccatcatcaaaggacacgccttattgagagtgctttcatactctcgagttgccaaaactaatcccccgcgaggaccgcgtaatgtcttatgcgttgttgttgtcactatatctgcataaggaataggattttcttcatcaacaaacactcccccagcaactaggcctgcaaaatgcgccatatctacccacaagacagatccacaatcctctgcaatctgttttaaaactgcaaagtttaatcttcgagaataggaagaatatcctgcgatcagtaccttaggtttatactccttagctaaccgggagatctctgcataatcaaaacactccgtatccggattgacatcataggggaagcaacgcataagcttagacatcacatttaaacgtacgttcccatgggtcaaatggcctccagaatttaatgaaggtcctaagcaaacacaagaagacatttcagccttaagtagagtgtattcttcttctgttaattcgtttacagttttataacctaacttactgacagctgggccttggactttgtgcgtgagaatggccattactgccagtaaattagcatcagccccagaatgaggctgaacacaagcgcaatccgcagcaaaaagttctttcgctgtctctacacactcccactcaatagcatctacattttcacaacaggaatagaaacgcttaaagggacttccttcacaatacttatctgtgagcaagttccccatagccaactgcactgaaagtgaagaatagttttcagaagcaatcatctttaaatgggaacgctggctcttcaactcatcaatgattctctccccaatggaaggaaacgcatttaagagatggtcaagagctgctaaatacgctgtcgaagctaaactttgtccctttttccccgaagcattttctaaaaacttatgcaacaacgaaaccaccgcaaccacctttgtaaatatttccactattgcgaatttcttaaatttctcaaaaacttttagcaaggacttctaaagacgaagccttaatagagagaacctctaagtccagaaaaaaccagcctagccttcaaagtgaaaaatgtcaatcaacgcatgatcaagaagaaccaagggaaaaagaaaaattattttcaatatatccctttgaaggtacaaaaacttaggcagccttccttttacccgaaaagactcatgaccctctacttaggattgaatcaaaaaaccgctcgtaaataccaagctcattatttgcctattctaactctcttcccctatgcaaaaagcactccacaaaataagcgtgctcttcaattccttccacaagcaacccatgtgattctcacaagtccctcatccactcacctattcctttccagaatgacttctcttctttctaaggccactctaaaaacaaagacctacctctgtataggagagtccaccaaagaaagacttctctctttccttggacaagtgaagtacgtagtagcaactcaagaaatcgctgaaggcatcttcccattgctacaggcactgccctcttcagcccgcattctctacccccactcctccctcgcaagacctgtgatcagagaatttctttacaatcgatttacttttttctcttaccctcactacacagtgaagccgcgaaaacttaaaaaaaatattttatctaaatacaaaaaaattatcttcacaagcccttcaactgtaagagctttcgccaaaatctttccgcgatttcctgaaaaaacctactggtgccaaggaaggatgaccttgcaggagtttcaaaagttctcctctcaaaagcaggtatctttgttagaaacgcttgggaagtccaggacatctccgtgacaaaaaagaccccactactttaaaatgctttatgctccgaaaaaaacttaatttttaatagtttatggcttcttcagctactcccggttttgatggaacggctccctctctatttcccccagctactcgtcctcgctataatttcaagcttgccctcttcgttactattgcgattgcactcgtctggatagctctgattgctaccaccatagctattgggctatgtatccaccctttgtgctcctttatcttcctaacagcaattcccttatactttatatctcgctatatttgctcccactacgcacgcaatgtctacatagctctagatgtcgtccccgatcattctaaattgcaagacatgcgctctcactctccaattttctcggatcgataaacaaaaatttgttaaaattatagaaagtattttacaaaaaaaatgttatgtcaggaccctcacgtactgagagctctcaagtttctgtactatcctatgtgcctcgggataaagaaattgctcctaaaaaacagtttaccatagcaaaaatatccactcttgcaatcctagcttctttagctttaggagctttggtggctggaatctctttaacgatagtattagggaaccctgtatttttggctcttctcattaccacggccctcttctcagttgtaaccttcttagtctaccaccaaatgacctcaaaggtatcttctaactggcagaaagttctagagcaaaacttcaagcctttgggaaaagcgtggcaagaaaaaaacgtagactgctactcaaacgagatgcaattttacaataatcacctgaaccctaagttcaaggtagcgatacaaacagatgcgtctcaaccatttcagcctactttcttaactggacttagagtgatcgaaaaaaatcaatccacagggatcatctttaatcccgtaggcccaacgaatctgatcgacaacactgcaacgaacctctctactatcctttactccaccctaaaagataaaagcgtgtgggatacatgcaagcaacgcgaagggggtcccgcaaaaggagaagaccccttttcccctaccgaagtgagagtagtaaaacttccaaacgaagctctagatcaaacgtttaatctaaatttaagctctgcagaaaagaaaagtattcttccgacctttttaggccacgtatgcggccctaaatctgaagagttaccaaatcagcaagaatattatcgccaagctttactagcgtacgagaactgccttaaagcagctatagaaagtcatgcagcaatcgttgctcttcctctctttacttcggtctatgaagtgcctccagaagagattcttcctaaagaaggcactttctattgggacaaccaaactcaagcgttttgcaaacgcgctttattggacgctattcaaaatacggccctacgctatcctcaaagatctttacttgttatactccaagatccttttaatactatagaatcacaaagtcgttctgaggagtaacccaaagggtttcaccaacaaccctttataaagtttagctaaaaattttctcaacatttaaaagtatatttttattttttactaaaaatgattaaatgcgctttggaagtgttcttacaggaacaatttacaagtaaaaattatatgaatggctagacattagttctaagaaaagggcatttcgcttgctcaaatttataagaattttccttacaaaaaaacatgctttacttcttgcctaaaaagaggtaaactgtatttttcttcacatgtatcgcattcctaaactccatagtgatttttggctttcttaggaaacttaagtaaggaataattttcatgcatgacgcacttctaagcattttggctattcaagagcttgatattaaaatgattcgccttatgcgcgtaaagaaagaacatcagaaagaattggctaaagtccaatctttaaaaagtgatattcgtagaaaagttcaggaaaaagaactcgaaatggagaatttgaaaactcaaattcgagatggagagaatcgcatccaagagatttctgaacaaatcaataaattagaaaatcagcaagctgctgtaaaaaaaatggatgagtttaacgctcttacccaagaaatgactacagcaaacaaagaacgtcgctctttagagcaccagcttagcgatctcatggataagcaagctggaggcgaagaccttattgtctctctaaaagaaagcttagcttctacagaaaatagtagcagtgtcattgaaaaagaaatttttgaaagcatcaaaaagattaatgaagaaggcaaagctttgcttgaacaacggacagagttaaagcatgcgacgaatcccgaactactcagcatctatgagcgtctattaaacaataaaaaagatcgcgttgttgttcctattgaaaatcgtgtctgcagtggttgtcatattgttctaactcctcaacacgaaaatcttgtaagaaagaaagaccgactcattttttgcgaacattgctctcgaattctctattggcaagaatcccaagtcaatgctcaggaaaattccacagcaaaacgtcgtcgtcgtcgcgcagctgtataaagttaatcggaagagaaaggcaaccgctgtttatatttctcaaaaaatataaagagaggaaagtctggacttcataagagaagatactggagaaattccaggggccgtaaggctacggaaagtgcaacagaaaacactccgctataaaatttattttatagacaggctgaaaattcctactttaggagtaggagccattaaggtgacttaataggcatgcaaaccctatctgaagcaagagaaaaaagctttttgtgtctgcaaatgtgagaggaattcctcccataggctttttcgaaatcgcttgagggatctagtaatagctcccctagatgaatggttgcccttaggatagttcgcaagagctatcttatagacagaatccagcttaccctctcttccgatatttttctcatattctcaaagtagaccagctttggctaaagtgtgcatatgcaacaagccagtcacatgtcggttctcctcgttatctaaaacaggaagaacagctacaggactactagattccataagttgcaaagcaatggcaatatccgaatcttcagtaatacatcgaggatttgccgtcatcaccttctccaaagataacgaaagcacctcccccccataggaagctaaagaacgccgtaaatctccgtctgtaaaaattcccataagtcggaattgaggatctactatacaaacacaaccacaaccgtaagcagaaaagacctctaaagaaaaactcactttatctccaagatgacagaaaggtacctctgtctttgggaacataaaatctttaaccttaccattagccttcatcccaacctgcccactaggatggtttttgccgtacgtagataaagaaacaccacgactatgaaaaaggagcatagctaaaaaatctccaaagatcatttggcatgtcgtagaatttgtagggattaaattaaaaggatctaattcagcaacagagggtaaaataacgactaagtccgagagagccgctaaattagaataaggcatggaagtaatcgcgacaagaatcgcccttcgactctttagatgaggaaccgtatctagtaactcttgggtttcaccacttttagaaaataaacatacaatgtctccaggactcacaagaccaagatccccgtgcagaagatccacaggagaaaagaacagagcacgttcacttaaagattggagtgtagccactaattttcgtgctacacatccacttttccctacaccagaaaaaaatacccatcccgaatgaccgagtattttttctgctaattgcattgcctctttgggttgaaaggcttggaaaaaaaaatctacagcttctttttgcttacctagaatgtcttggcatacgtcagtagaaatcatcggggaaggcattcggttctctttggattggctacactttagcccatcgtaacagactccaaacgatttttcaatgaggttaaaaactcactgccgtaaataccatccaatactctatggtcaaaggtaagtgtcacatagaccattttgcgaatggctaaagaatcgtcatcacggacgacaacacgtttttgtattgtgccaattcctaaaatagcaacttcaggataacgtatgatgggcatcccaatcaaagctcccgtcattccaaaattcgtgacagtaacgctgccatcttgcacttcactaggatccaatttatttaaccgagcccttgaagatagatccgccaaggcctttgcaatacttactaaaccgcgatcttgacaattgtggatgacaggaacaacaaccccttccttattgaggttcacggcaacgcctacattcacagatttcttcataacaatggtagtcccatctaaggaaccattcaataaaggaaactgccttaaagtctgagctaaacactgtacaatgaaacttgtaatcgttagcttcaccccatgcgtatctaagaagcgttggcgttcaccagaaatcagattcataagatctgtgacatcgacatcaacaaccaaagatgcgtgaggaacctcatctgaagacttggagagagaagaagctattgcccgacgtagcggagacataggaatgcgattcacttctccttgaaatatttcgggaatagaaacttgttgcgattctgaaatatacgcttctaaatcctgacgagtcactcgtccccctttccccgtgccggcaatcttttggaggttatcaagaccaatgccttcacgttgagctaaactcagcacggcaggagaaaaccataccgaagaactgctggaacccgcctccgactttgtttcacaagaagtcggaggacatgaggtgctctcatcatcagcttcggaaatctcctcaagctctatcaatcctaaaacatccccagaagcaacctcgtctccctcattgacgcagaaacgcaccagtcggcctgctttaggagagggtaattctgtagcaattttatccgtagatacttcaatcagaggctcatctctagctacatgatcacccaaattttttaaccaacggactatagatcctccggaactcgtctctcctattttagggaatcggaactcaaatatcatgtatcgttaccttctatgtagtttcaacgctttcctgttttatcgattcataaggagaaagctctccttctccagaagctacataagtagcaactacagcatccccaagaatattcatgggtgtacctacaatatcccttaaccggtcaatcccagcaagtatagcgataccctggataggtaaacctacagaggctaatacggaacccagagtaatcatacctcctccaggaacaccggcactacccacggcagagaatgttgcggtaactaccaataataacagactgctcaaggatagcggacaattgtatgcttgagcaatgaaaaccgctgccataccctgaaaaattgcagttccattcatattcacagtggcgcctagaggcaaaacaaaaccagaaacctcagcggacactcccaaatttttagaaacacaacgcatcgttacaggtaaagtcgcagaactactcgctgtagataccgcgcaagaaatcgcatccatcattgaagagagaaacttcgaaaaggacatcttgcaaccaaaacgcacaagtcccccaaaaacaagcgtagcatggaacaaacacgccagatagtaagcaatgataaatttgcctagctgccaaaggactcctaaaccatgatttcccgaaatccatgccatgctagctcccacaccatagggagcaaaactcatgatcatatttaccatgcgcaacatgatttcagaaaaaccatcaataaaacgctcgacagggcggccacgttctccagaaagccgaagggcaattcctaagaaaatcgcaaaaataataatttgtaatatattcccttcagcaaaagagcgtacaggattcgatgggaaaacttgagctattatagaaagaaaatacgccgctgttttgtttgaatcaatgacagtaacggccgaatccatagattgggcctgggcaaaatcacacccatttcctggagagaaaatccaagcaaaacacaagccaatcacaatagctagtgccgtagtccctagatagaggccgacacttttaatgccaatgcgtcccaattttttcatatcgctaatggaagcgattcctaaaaccattgagcagaacactaaaggatacactaccatgctcaatagatttaaaaagatgtctcctataggtttaaaaaagatggctttatcttctaaaactaaacctaaggtaaccccgacaaacaatccaataaagatcttcatccataatttcattagttacccctgtttttatgtatttgttcaatcatgttgagaagagaaagtgtatcgtcttgattcacagaaaggcgcatttccaccttagctatcggcaataaacttacctctcctgataatcgaggaagctttacactatctttttctgtacataacaacccttgtccttggcgcatggccatttgctgacaaaagtaatttaattctttttttgttattgctgcgtgatcaggcaataaatactttcctaaaatatgaattccttcttctctaagcatattcaaaaacccttgaggaaaccctaaaccacaaaaaacccccacacgcaattctcgaagagcctctttaggaatacgctctccgttatgggtccaaactacagaagctattgtaggtttcacaaagatctggggggcattcgaaacacgtttcactacagtcccagcctcttttccaccgccatttacaataatggcatccacagtcttcaatcgaagaggaaaatcccgaagccttcctttagggaagaaggcacgtcctcctaaaggatcctgaccattcactacagcaatttctacgtctttgtgtagtttacggtactgaagaccatcatctaaaaggagaataccaaatttctctgcagcgcgtgctgcagagatcctccggtccttatgcacccatacggatccctctggcagtttctctgccattaataaaggctcgtcccctacataggacgcagaatggactttcgagtctacaacagtcagtttcttttgccgactcgactggcttttatagccacgcgacagtacaccgcaagaataccctcgaagcctcaaagcctctgctaaccacaatactgttggagtctttcctgcccctccaacaacgatattgcctacactaatgactgtagaacgcgcacgataaggagtagaccaggaaaatcgattccaacatgccaccaagaatgcaaaaactttggaaagaagggaacctaaccagccccatcccaaaataccctcaaggctaatagctatggtgacacggcgataaaagagaaagagtgtggaaggaaaccgttttttcattgttcctcttttaaacgcacgaatttctttgcacgaaaatcatgctttttaaaagatcacaatcttcgccgtattacaaagaatgctagtattgcagaagaaaagattaaaaatcaagtttacaaagcttaattaaaaaattgtgttaaacaaaaaactaatataattaatttgatctcaaaaagaaaaatggtgtactaattaacccaacgttgacgaacaacttcataagctacagcagctacagatgtagcgagattcaaagaatctgattcccctaacataggaagagcgatttcagaaaaatcttcagaaaaccaatcctcagtcaaaccatctttctctgaaccaaaaaccaaagccgtgggaccaagataatttttagaaaaatacatagtttcagctcgaggagatgtgacaaaaacagtccagccttcctgcttgaacaactccttcccttcctctcttgaaatagagaggatgggaagagaaaagacagctcctaaagaagagcgcaccacattaggattgtacaaatctacaataggattgcataaaatcacaccgtcaacaccagcaccatcagctattcttaaaatagcaccgacattcccaggtttttccacctgctcaataataagatagaaaggctgagcatttttacgttggatcaaaaaatcttctttattccacactctcttttgtatcaccgcgacgaaactatcgtgatgttctttaaaagaaagttgagccaaagtcgagtctaagcaatataaaatctttgtagaatttctttttaactcatataaaaattccttttctttttctgaaagatgtgtcgaacaaaaaacatgctgacacaggtagcctgtgcgtaatgctttctgaatctcacgggctccttcaactagaaaccaagaactttttctacaacgagaccgttttaaagctagagcctctttaactagaggattatgtttccctatgcaatccattgaacaaaactcccagaaggcaaggctcccacaccttctccacaaaaactttccccacaagaccacgcttcagaaacaagggttggcacgctacgcctagctatagcccttaaaaactctggggtatgtcctggagtatgagaggttaagagaaaataagaagcgtcatctgcaagaagcttcgaacacaaagaaagcaaaggaaagagatctttatctattttaaatacttccccatcaggtccgcgaccatagcttgggggatctaaaagaatcacttgatatttcttatttctgcggatttctttttttaaaaaagaaatcacatcttcaataacccaaaaaatacgtctctcaggaaaagcatttttctctacatttctttgcgcccaacgtaccgctgcctgcgaagcatctacatgggtcacacgagctccacacttagctgcaaaaatagaacccgcccctgtataagcaaagagattcaatacctgacgttctttgtgcttctcaatggcttgtttcaaagcgggccagaaccccatatgttcaggaaatacgcctagatgcccaaagggggttctcttcaatagacaacgcacatcagaaaatgcgacctcccattcttcaggaagacgcttaaaatttttccatgctcctctttctccttcacgaacatactgcaattgcgcctgagaccatagttcaggtctgctttttggccaaacagcaatacttgaaggacgaattaaagtgacaggaccaaaacactctaatttgttcccgtccccactatcgagcaatttataatccataactaatctttccctgatgaggctaaaatacgttttactgtgtctacctgtatctttgttgacatatcgatctcgatattgactctttctccttcccttttctttcctaaagtcgtcctttgaagagtctcaggaatcaatcccacagaaaacgtatcactatcaactgacactagcgttaagctgataccatcaattgcaataaaccctttttcaaaaaggtactgagataattctttggaaccacggaaataataacgattttcttttatcaagaaaatctctgctgttccaaaaacatgcccagagagtaagtgacctccaatcgagtctcccatttttaatgcagcctctaagttcacttgatcgctacatcttttttctcccaaagtcgtacaagctagagtttctggaatcacatcaaaaaagatcttactttcattgcatgatgttaaagtcaaacagactccatctacggctacgctatcccctgtaaccagaggggtgacaaatagtggcgtgctcttaattcctaaactcagaccatttccttgagcttcaaaaaaacacacttcacctaattcttgaataattcctgaaaacatcccaccccatttaacaacagaatctttacaacaaaagctttcctagagtagagtatgtttttttcgtctcaataagcaaagcaattttgcacagaaatttaagataatacgaatccctaaagccgtttctttagagaagtatttcctctacccttgatttcctagaaaaaaactttgcaactatagtctcttatatttatcctgatctaaaaattcggtttttcttagactaccttaacctaggaggtagctcccatgcagtgtcctttttgcaatcatggggagttgaaagttatagattcaagaaacgctccagaagctaatgcaataaaacgccgtcgggaatgcttaaagtgctcccaacgttttacgacctttgaaaccgttgaacttactttacaagtactaaaacgtgatggtcgctacgaaaattttcaagaatctaaattaattcacggtctgaacgcagcttctagccacacacggattggtcaagaccaagttcatgctatagcttctaatgttaaatctgaactcttaggtaaacaaaatagggaaatttctaccaaagaaattggcgaactagtaatgaaatatcttaaaaaggctgatatgattgcctacatccgatttgcctgcgtttatcgtcgattcaaggacgttggtgaattaatggaagttttattgtcagcaactccagatatggaaaaatagttgaattttataaggagcaaggttgtgccgttatcagatgacgaaatagaacagtttaaaaaaagacttttggagatgaaggcaaagttatcgcatactctagaagggaacgctcaagaggtaaaaaaacctaacgaagctacaggatattctcagcatcaagcagaccaaggtaccgacacctttgatcggactattagcctagaagtcactacaaaagaatatgagcttctaagacaaattaatagggctctagaaaaaattaatgagtcttcttacgggatttgtgatgtcagcggagaagaaattcctctcgctaggttgatagccattccctatgctaccatgacagtcaaagctcaagagcagtttgaaaaaggactcctatctggaaattaagttctatggcaactcgttttcgtagcacactattagtgattactctgtttgttttaatcgactgggtcaccaagcttgttgtcttattacaatacaaagatctccaaattttaacgcaccccaccttatatactcatagttgggggcggttttcattttcaattgctcctgtatttaatgaaggggctgctttcggtctcttttcaaattataaatatttcttattccttctgcggatatttgtgattcttggcctcctggcctatcttttttttaaaaaaaaatctatacaatctacaacgcagactgctctagtccttctctgtgcaggagctataggaaacgtcggggatattatcttttacggccacatagtcgatttcatttctttcaattataaacaatgggcattccccacctttaacgttgccgatgtattgatttctcttggcactctgctccttgtttataaattttattttcctacaaaacaaactgaaaaaaagagataatatagatctcttcaagagaagctaagatatttttttaaaactgttatgaaccgtcttctatcgcttttatccgtctttgatgattttttctggtcctatgtggcctttattctaatcattgttctaggtgtaagtttttcctggaagtcgcgattttttcaattcacgaagttctctcagttttgcaagcttttccgttattactctcagaatcctcaagaaagagaaacaaagcaaggtgtccatcctctaaaagtattttttgcctccgcaggcggaaatatcggcatagggaatgtcgtaggaattgtcacagcagcatgtatcggtggacccggggctcttttctgggtgtggattgctgggatctttggttctattgttaaatattctgaggtctatctcggaatcaagttccgtaagttagatcgtgatggcgtctatcagggcgggcctatgtattttcttataaaggcgttcaaaacccctgtcgtgtctgttattgttgcgattcttctctgcatttatggagtggaaatctatcaattttcagtcatcactgacagccttgcccactgttggaacctacctaaagtctatccgatgttaggtctactcttccttgttttctatgcaattcgaggaggcttgcagcgtataggaaaaatttgttctatagttcttcctttcttcatgctcttatactgtgccctatccctctacatcctcgttaaagagtttcatacccttccacacctactttccacagtattttcttctgcatttaaaggtcaaagtgcccttggaggatttgcaggctgtactgtagccactacgattcatcaaggaatttcacgagcagcctattctggggatatcggtataggctttgactccatcattcagagtgaaagttctgctaaagatcctagcacccaagcgcaactcagtattgttgggattgccatagataacctgatctgtactctgagtcttctcatggtgcttgcttcgggctcctggtctctgggattagagaatgcttcccaagtagtagaacacactctagcaagctacttccctatggtgaagttcttcctccccaccttcttctttgttacaggctatacaaccatcatctcctacttcctggttgggaagaagtgtgcaaagtttctttacggaaacacaggggcaaagatctatactctctatggtcttctgattcttcccttattttgtttcctcagccaaaacacagctttgttgatcatgtctgtatctggagccctactcctttgctttaacctcttaggagtcttcatcttaagaaaagaagttatcttccctgcaagggctgcttctctcacagaaacttctctttctacagaataaaaaatttaccttattcatacacaatgagataagaagttttaatttttattaataaattaaaagattagttttagaaaaaaacacttcatagaaagtaaaataaaagaataaaagttgtaattaatttttttactttttatggataactatctcctcggaagcttgattttctgttgtgtacttctatcaatagggatgtgcacgattttcgtgatgacgatctgctttctacgccaactcaataaaatccttaaaaacatccatcgggtgactacaattttaaattttgaggctaagatcctagctcctttgatgttagggaaaaagcttctctgtggatggctaaagaaaagaaaaaatcgcggctctctgtctgaagacattgacgaactcttagatgagaaaaagcagagaagctggaaaaaaaacttagaccaaggaattaaatggtgcgcagcactggtcctcatttggaaagtgtttcgtaataaagattaaaacattgagggatatcgttatgttcaggaacaaccacaaacctaaaaaaactaagtgcaaacgatttcgctggctacggggtgttttattcggtggattcatagctacgttattaacatgcttgtttactcccaaaagtggcgtccaactgcggaagaaaatcctcaaagtaaaaaactctggggcaaaaaaaagtagagtgttctttaaaaattccaagcaacataccaagtcattcgtaaaacaagcgaagttgctagctaagaatatctcacacgaacttcaagattttaaaaagggaatcctcgacgacaaagattagagttgctattaagaagctctgtatgattgagatatcttctcagggctttttttcatttaaaagcacataaatagaggctctctccgagaaatgccattctcgagtcaactttttatttccgtgtatttatttttctgttctatgtaagtttagatctgtataaggctataacttattaggactccgacatatgaagcagatgcgtctttggggatttttatttctctcttccttctgtcaagtttcttatctacgagcaaacgatgttctcctccctctatcagggattcattctggagaagaccttgaactctttactctacgcagttcctccccaacaaaaactacgtattctctacgcaaagattttattgtttgtgattttgcaggaaattctattcacaagcctggagctgcattcctgaacttaaaaggcgatctattttttataaatagcactcccctagcggctcttacctttaaaaacattcacttaggagctcgcggtgctgggctcttctcggaatccaatgtgaccttcaaaggcctgcactctctcgttctcgaaaacaacgaaagttggggaggcgtcctcaccacatctggcgacctttccttcataaataataccagtgtgctttgtcaaaacaacattagctatggacctggaggagcgctactcttacaaggaagaaaaagcaaggctctctttttcagagacaatcgaggaacaattctatttctgaaaaacaaagccgtgaatcaagatgaatcccatcctgggtacggaggagctgtaagtagtataagtcctggctccccgattaccttcgctgacaaccaagaaatcctattccaagagaatgagggcgaacttggtggagccatttataacgatcagggtgccataacttttgagaataactttcaaaccacaagctttttctctaacaaagctagtttcggaggagctgtctatagccgctactgcaatctctattcacagtggggcgataccctattcactaaaaacgctgctgcaaaagtaggcggagccatccatgcggattatgttcatataagagactgtaaaggaagcatcgtctttgaggagaactcagcaacagctggaggggcaatcgcagtaaatgcagtttgtgacattaatgctcaaggtcctgttcgctttataaataactctgcgttaggactaaatggtggtgctatttatatgcaggctactggatctatattgcgcttacatgcaaatcaaggagatattgaattttgtggaaataaagtacgatcgcagtttcattcacatataaattccacttcaaacttcacaaataatgccattactatccaaggagcgcctcgagaattttcgctcagcgcgaatgaaggacatcgcatctgtttctatgatcctataatttctgcaacagaaaactataactctctgtacatcaaccatcagagacttttagaagccgggggtgctgtgatcttttcaggagcacgcctatctccagagcataaaaaagaaaataagaacaaaacttcgattataaaccagcccgtacgtctctgttctggagtcctttctatagaagggggcgcgattcttgctgttcgttctttttatcaagaaggaggtcttcttgctctcgggccaggttctaaactgaccactcaagggaaaaattctgaaaaagataaaattgtcatcacaaatttaggattcaacctagaaaatctagactcttcggatcctgcagaaatccgagctacagaaaaagcctctattgaaatttctggagttcctagagtctatggtcacacagaatctttctatgaaaatcatgagtatgcctccaaaccttatacaacttcgattattctatctgccaaaaaacttgttacagctccctctaggccagagaaagacatccaaaatctcatcatcgctgaatctgagtatatgggctacggctatcaaggctcatgggaattctcctggtctcctaacgacactaaagaaaagaaaaccattatagcctcttggactcctacaggagaattttctttagatccgaagcgccgtggatctttcattcccacaaccttatggtcgacattctctgggctgaatatagcatcgaatatcgtgaataacaattacctcaacaactccgaggtcatccccctgcaacatctctgtgtttttggaggccctgtctatcagattatggagcaaaatcctaaacagagctctaacaatctcttagttcaacatgcgggtcataatgttggagctagaattcctttctctttcaataccatattgagtgctgcacttactcaactcttctcttcttcatcacaacaaaatgttgctgataagagccacgcgcaaatattgatagggactgtatctcttaataaaagttggcaagcactatctcttagatcttcatttagctatacggaagactctcaggtaatgaagcacgtattcccctataaagggacctctcgaggatcttggagaaactacggatggtccggatctgtcggcatgtcttacgcctatcctaaaggaatccgctatctaaagatgactccctttgttgaccttcagtatacaaagttagtacaaaatccctttgtggaaacgggttatgaccctagatatttttcttcctcggagatgacgaacctatctctaccgataggtatcgctttagaaatgcgctttataggctcgcgttcttccctatttctccaagtcagcacctcgtacattaaagacttacgtcgggtcaacccacaatcttcagcttccttggtgttaaatcactacacgtgggatatccaaggagtccctctagggaaagaagctctaaacattaccttaaatagcacgattaagtacaagattgtgactgcctatatggggatttctagcacccaacgagaaggcagtaacctttcggcaaatgctcatgcaggcctctcccttagtttctagaagttagcactatagaaataaaagaagacttaaaaagcgcgtggttatcattcaaacacgcgcttttttatcccttgcctaatttatccatctgatttatctatcacttatcgagtttgtgaatatatctgataggttttcctctatgaagtggctaccagctacagctgtttttgctgccgtactccccgcactaacagccttcggagatcccgcgtctgttgaaataagtaccagccatacaggatccggggatcctacaagcgacgctgccttaacaggatttacacaaagttccacagaaactgacggtactacctataccattgtcggtgatatcaccttctctacttttacgaatattcctgttcccgtagtaactccagacgccaacgatagttccagcaatagctctaaaggaggaagtagcagtagtggagctacatctctaatccgatcctcaaacctacactccgattttgattttacaaaagatagcgtgttagacctctatcaccttttctttccttcagcttcaaatactctcaatcctgcactcctttcttccagtagcagcggtggatcctcgagcagcagtagctcctcatcatctggaagtgcatctgctgttgttgctgcggacccaaaaggaggcgctgccttttatagtaacgaggctaacggaactttaaccttcactacagactctggaaatcccggctccctgactcttcagaatcttaaaatgaccggagatggagccgccatctactcgaagggtcctctagtatttactggtttaaaaaatctaacctttacaggaaatgaatctcagaaatctggaggtgctgcctatactgaaggcgcactcacaacacaagcaatcgttgaagccgtaacttttactggcaacacctcggcagggcaaggaggcgctatctatgttaaagaagctaccctattcaatgctctagacagcctcaaatttgaaaaaaacacttctgggcaagctggtggtggaatctatacagagtctacgctcacaatctcgaacatcacaaaatctattgaatttatctctaataaagcttctgtccctgcccccgctcctgagcccacctctccggctccaagtagcttaataaattctacaacgatcgatacctcgactctccaaacccgagcagcatccgcaactccagcagtggctcctgttgctgccgtaactccaacaccaatctctactcaagagaccgcaggaaatggaggcgctatctatgctaaacaaggtatttcgatatccacgtttaaagatctgaccttcaagtctaactctgcatcggtagatgccacccttactgtcgattctagcactattggagaatctggaggtgctatctttgcagcagactctatacaaatccaacagtgcacgggaaccaccttattcagtggcaatactgccaataagtctggtgggggtatttacgctgtaggacaagtcaccctagaagatatagcgaatctgaagatgaccaacaacacctgtaaaggtgaaggtggagccatctacactaaaaaggctttaactatcaacaacggtgccattctcactacattttctggaaatacatcgacagataatggtggggctatttttgctgtaggtggcatcactctctctgatcttgtagaagtccgctttagtaaaaataagaccggaaattattccgctcctattaccaaagcggctagcaacacagctcctgtagtttctagctctacaactgctgcatctcctgcggtccctgctgccgctgcagcacctgttacaaacgcagcaaaaggaggggctttatatagtacagaaggactgactgtatctggaatcacatcgatattgtcgtttgaaaacaacgaatgccagaatcaaggaggtggggcttacgttactaaaaccttccagtgttccgattctcatcgcctccagtttactagtaataaagcagcagatgaaggcgggggcctgtattgtggtgacgatgtcacgctaacgaacctgacagggaaaacactatttcaagagaatagcagtgagaaacatggaggtgggctctctctcgcctcaggaaaatctctgactatgacatcgttagagagcttctgcttaaatgcaaatacagcaaaggaaaacggaggcggtgcgaatgtccctgaaaatattgtactcaccttcacctatactcccactccaaatgaacctgcgcctgtgcagcagcccgtgtatggagaagctcttgttactggaaatacagccacaaaaagtggtgggggcatttacacgaaaaatgcggccttctcaaatttatcttctgtaacttttgatcaaaatacctcttcagaaaatggtggtgccttacttacccaaaaagctgcagataaaacggactgttctttcacctatattacaaatgtcaatatcaccaacaatacagctacaggaaatggtgggggcattgctgggggaaaagcacatttcgatcgcattgataatcttacagtccaaagcaaccaagcaaagaaaggtggtggggtttatcttgaagatgccctcatcctggaaaaggttattacaggttctgtctcacaaaatacagctacagaaagtggtgggggtatctacgctaaggatattcaactacaagctctacctggaagcttcacaattaccgataataaagtcgaaactagtcttactactagcactaatttatatggtgggggcatctattccagtggagctgtcacgctaaccaatatatctggaacctttggcattacaggaaactctgttatcaatacagcgacatcccaggatgcagatatacaaggtgggggcatttatgcaaccacgtctctctcaataaatcaatgtaatacacccattctatttagcaacaactctgctgccactaaaaaaacatcaacaacaaagcaaattgctggtggggctatcttctccgctgcagtaactatcgagaataactctcagcccattattttcttaaataattccgcaaagtcggaagcaactacagcagcaactgcaggaaataaagatagctgtggaggagccattgcagctaactctgttactttaacaaataaccctgaaataacctttaaaggaaattatgcagaaactggaggagcgattggctgtattgatcttactaatggctcacctccccgtaaagtctctattgcagacaacggttctgtcctttttcaagacaactctgcgttaaatcgcggaggcgctatctatggagagactatcgatatctccaggacaggtgcgactttcatcggtaactcttcaaaacatgatggaagtgcaatttgctgttcaacagccctaactcttgcgccaaactcccaacttatctttgaaaacaataaggttacggaaaccacagccactacaaaagcttccataaataatttaggagctgcaatttatggaaataatgagactagtgacgtcactatctctttatcagctgagaatggaagtattttctttaaaaacaatctatgcacagcaacaaacaaatactgcagtattgctggaaacgtaaaatttacagcaatagaagcttcagcagggaaagctatatctttctatgatgcagttaacgtttccaccaaagaaacaaatgctcaagagctaaaattaaatgaaaaagcgacaagtacaggaacgattctattttctggggaacttcacgaaaataaatcctatattccacagaaagtcactttcgcacatgggaatctcattctaggtaaaaatgcagaacttagcgtagtttcctttacccaatctccaggcaccacaatcactatgggcccaggatcggttctttccaaccatagcaaagaagcaggaggaatcgctataaacaatgtcatcattgattttagtgaaatcgttcctactaaagataatgcaacagtagctccacccactcttaaattagtatcgagaactaatgcagatagtaaagataagattgatattacaggaactgtgactcttctagatcctaatggcaacttatatcaaaattcttatcttggtgaagaccgcgatatcactcttttcaatatagacaattctgcaagtggggcagttacagccacgaatgtcacccttcaagggaatttaggagctaaaaaaggatatttaggaacctggaatttggatccaaattcctcgggttcaaaaattattctaaaatggacctttgacaaatacctgcgctggccctacatccctagagacaaccacttctacatcaactctatttggggagcacaaaactctttagtgactgtgaaacaagggatcttagggaacatgttgaacaatgcaaggtttgaagatcctgctttcaacaacttctgggcttcggctataggatctttccttaggaaagaagtatctcgaaattctgactcattcacctatcatggcagaggctataccgctgctgtggatgccaaacctcgccaagaatttattttaggagctgccttcagtcaggtttttggtcacgccgagtctgaatatcaccttgacaactataagcataaaggctcaggtcactctacacaagcatctctttatgctggcaatatcttctattttcctgcgatacggtctcggcctattctattccaaggtgtggcgacctatggttatatgcaacatgacaccacaacctactatccttctattgaagaaaaaaatatggcaaactgggatagcattgcttggttatttgatctgcgtttcagtgtggatcttaaagaacctcaacctcactctacagcaaggcttaccttctatacagaagctgagtataccagaattcgccaggagaaattcacagagctagactatgatcctagatctttctctgcatgctcttatggaaacttagcaattcctactggattctctgtagacggagcattagcttggcgtgagattattctatataataaagtatcagctgcgtacctccctgtgattctcaggaataatccaaaagcgacctatgaagttctctctacaaaagaaaagggcaacgtagtcaacgttctccctacaagaaacgcagctcgtgcagaggtgagctctcaaatttatcttggaagttactggacactctacggcacgtatactattgatgcttcaatgaatactttagtgcaaatggccaacggagggatccggtttgtattctagggtatacaattaaagattttatgaaattgaggatacggagagagtgggattcgaacccacggtacgcgttaacgcacacacgctttccaagcgtgctccttaagccactcggacatctctccatatttatagattttccaggcaaaaagacttgccgagaacatatcttaacctttccatttttatcaacatccgtcttactatgagaattttttcctaagatcaccgcttcttaggatattcgttctttattaaaattatgccccaatagaataatagatcatcttatcaaactgcttttgtcatgcataaagtaatagttttcattttccttaccctatattcgttaaaaagttatgggaatgatgtaatagataagccccatgttcttgtcagtatcgccccctataaattcctagttgaacaaattgctgaagagacctgttttgtctatgcgatagttacgaatcactatgatccccatacctatgaacttcctcctcagcaaatcaaggagttacgacaaggagacctttggttccgtataggagaggcatttgaaaaaacttgtgagagaaaccttacatgccaacaagtcgatctttcccaaaatgtctcgctgattcaaggaaagccttgctgtaatcaacataccacgaactacgacacccacacttggttaagccctaaaaaccttaaagtccaagtggagactatcgttaccactttaagtaaaaaatatcctcaacacgcgactctatatcaaagcaatggagagaaacttctgttagctttggaccaactcaatgaggaaattcttacgattacctccaaagcgaaacaacgccatattttagtttcccatggagcctttgggtatttttgccgtgattacaatttctctcagcacactatagagaaaagcagtcatgttgagccttctcctaaagatgtggctcgcgtatttcgtgacattgaacagtacaaaatttcttctgtgattcttctcgaatactctggaagacgaagtagtgctatgctggcagatcgtttccacatgcatactgtgaatctcgatccctatgcggaaaatgtacttgtaaacttaaaaaccatagcgacgactttttctagtttatgacaatacgaattcttgctgaaggcctagctttccgttacggaagcaagggaccgaatatcattcatgatgtttctttctctgtctatgatggcgactttataggaatcataggaccaaacggaggggggaaaagcaccttaacgatgttaattttgggcttgcttactcctacattcggatccttgaagactttcccttcgcattccgcggggaaacaaacccattccatgatcggttgggttccccaacatttctcttatgatccttgttttcctatctcagtaaaagatgttgtcctctcaggaagattgtctcaactctcctggcatggaaaatataaaaagaaagattttgaagctgtagatcacgctttggatcttgttggactttctgaccaccaccaccactgcttcgcccatctctcaggaggacaaatccagcgtgtacttctggcaagagccttagcctcctaccctgaaattttaattcttgatgagccgacgacaaacattgatcctgacaatcaacaaagaattttaagtatcctaaaaaagctcaaccgtacgtgcaccattcttatggtaactcacgatcttcaccatacgacgaattactttaataaagttttttatatgaacaaaactttgacttcattggcagacacttcgaccttaacagaccaattttgttgtcatccctataaaaatcaggaattttcatgctctcctcactaatccgtgattcatttccccttcttattttacttcccacattcctagcggcattaggagcctccgtagctggcggcgttatgggaacctatatcgttgtaaaacgtattgtttcaattagtggaagtatatctcatgcaattctaggaggaattggcctcaccctatggatacaatataagcttcatctctcttttttccctatgtatggagctattgtaggagctatttttctagctctttgcatcggcaagatccacctgaaataccaagaaagggaagactctttgattgcgatgatttggtctgtgggcatggcaattggaattatattcatttccaggcttcccacctttaatggagagctcatcaattttctatttgggaacattctctgggtcaccccttcagacctctatagcttaggaatctttgatcttcttgttttaggaattgtggtcctttgccacacccggttccttgctctttgctttgatgagaggtacacggctttaaaccattgttctgtacagctgtggtatttcctacttcttgttctgacagcaatcacgattgtgatgttgatttatgtgatgggaacgattctgatgcttagcatgctcgtcttacctgttgctatagcgtgtagattttcgtacaagatgacacgaattatgttcatctcggtcctcttgaatatcttatgttctttttctggaatttgcatcgcctactgtttagatttcccagtaggtcctacgatatcattgctgatggggttaggttatacagcgagtctttgtgtgaagaagcggtacaatccgtcgacgccttctcctgtaagtcctgaaatcaatacaaatgtatagctagggaagcgcttttggaagctttggaggcattcttcctgttcgtcaggaagaagatcatcaattttatttaaagctaccagcatatctttcttttcaaaatctggctgatgagagtggagctcgtggatgagcgtttctaagtcttcttcgggagagtttctctctcttttggagacatcgataacaaatagcagtaaaagagtgcgctcaatatggcgaagaaaatcgagtcctaggcctttgttttgatgagctccttcaatgattcctggaatgtcagcgataatccagggtttttgatacaaacgatctttacaaaggactaggcccaaagagggggccagagttgtgaagggataggctccgactttcacttcggtatgtgcgagtgtattaaatagtgtggactttcctgcatttgggaaccctaccaaaccgatatcagcaatgagcttaagttctaactctacctgacggatttctccgggttttcctggggtggcttttgtaggggctcggtttactgaggtcttaaagaaggtatttccttttcctccctttcctccttggcttactaggagacgctctccatctacggtaaagtcatgaaggatttcaccagtctcagcatcacgaagcagggtgcctgtagggacagaaactattagatctttaccactgcgtcctgtgcggttatttgtagctcctgactgaccgtcgggagccttgagaaagcggatatttctataagcttcgaaagaatatacacttgtggtggcttctatgattacggagccgccattgccaccattgcctccgtaaggccctcctttaggaaggtatttttcctttctccaagcaacaacgccgtttccgccctttccagcacgcaattctaaggtaatttgatctacaaacatgattacgtttttatccttcttcaaacaaaaaaagctcgatttgatgcctgagcaaaaaaccgagcttttttaatgtttctgaaaaatcgaaaaataggaactaaagttgctcaggaacaacagagatataagtacgattcgtctttttcattactacaataccatcgactaaagcgaatagggtatcatcacgaccacgacctacattttgtgcaggattccatcgggtccctctctgacgaacgagaatacttcctgtagaaactttttgcccagcgcccactttaaccccaaggcgcttcgattttgaatctctaccgtttcggcttgccccttgtcctttcttatgtgccataactctaaactctctagcttctgtttatatcaatatctcacggattttcacacgaaggtacttctgacgatgtccgtgtttacgatgataatttttgcgttttttatacttataggcgactactttttctcctttaacatgagaaagatattcggcttttacttgtgcgttcgcaatcgtagggcttcctagagaggctttagttccatcgaatacaaagaggacatcttgaaaaatgacttctttatccgaagcaacttcccctagtaactcgacatcaatcacatcgcctgagcgaacctgatattgcttgcttcctgtttggattactgcgtagggctccatcaattttttccttatgaatctttcaatgcttaaagttaagcgctgtttgctaagttactttagcaaacttaaggattatacaaaatataaagtcttggattatagtttttaacccctcggagagcgctatcctcaagcggttatggccagagccgggatcgaaccgacgacacaaggatcttcaatcctctgctctaccatctgagctatctagccatttgtactcagttatcataggaaaacattcagtttaatatcaatgagatttcgaattcttcgcctctctttttgctattaaggagtatttctcaagagagtgcttcgatgtagcgagaaagtttgacaaattactggaataatgcgtgaattttagaaattttgtagtatcttctgtgaaagaaattcttaaaaaaaacatataccaggtagttatggatagagacaatgaggttcccctgcccaagcccaaatggatttaccgtacaggtattggtcaagacagccaccgctttctcccagaaagttccacgaagccctgcattttaggtggtatcatttttgatcattgcccaggatttcaggcaaattccgatggagacattatctttcatgccatttgtaatgcgatttcctcagtaactaataaaattattttaggaaaggttgctgatgagcttctccaaacacggggaattacagatagtgggatttatcttgaggaggctttaaaatctctgaagcctaatcaaaagatttctcatgtcgctattacgattgaaggaagtcgacctaaatttctctgtaagctatctgcattacgtcaaaatattgcccaggttatgaacttaacacctacggatattggcattactgcgacttctggagagggtttgagtgactttggctgtggagatggcgttcagtgtttctgcgtcttaactgtgatggaatactgtgactaatagacgtcaacaacgtaacgatgttcctttctgagggaggctagagtatcttttcctaagatttcttctaaagcgtgttttacttctatgcctaagactttacgtccacagacaaagaaaaaccctccctcttcataggcctttcttacctcatctttttgaatcctaagaagatcttgaacatagactttttggtctctctctcttgagaaggctaaaaagagttttagttttccttcctcttctgcatggttccagaattctcgataatagaagttcactttttctttgcgctcaccaaaaaatagtaaattatttcctgggtctttattgaaaaggcgttcctctaggaaggctttataaggagcgattcctgttccagctccgatcataactaagggtttcccttcagtctgtgtagatagagtgaagtgttttgtaggttgtacgaatatgtaggcagaatcgttgacctgtagttcgctacatagaaaggacgagcaaactccgaagcgtttttgatattttccaggataggaaacgtgttttaccaatagctctatacttttgggatgtagatctggtgaggaggctatagagtagaaacgaggcaataaaggaaacacactctcagcgaagagttctattgggatctgagggcggtactcttgaatggcatcatacagtgtaatcttaggatctttgtctgggaaaaaggaatttagctttgctggaattttatcaagatcaacatagccttggataaatttttgggcagaaactttttcagaagttttttttacgttgacaagggtcgttggggaatagcctagaagctggagaacgtgttcggagacctctttagaattctctggtaagactcctaaagcatcgcctactttataggatatagtcgtatcattgctatcaaagaccatgcggtagatgggatcgctatcgttaatggaatcggaacaagaaagtagctcacgcaatactagaggaacttgctgagccttaaacttttcttgtaggtacatcttttatagacaagcttgaattaagccgctttgattttaatatcaactcctgcaggaagtgctaacattttcaaagcatcgatagtttttcctgtgggatctaaaatatctacaagacgtttgtgagtacgaatttcaaactgctctcttgattttttatccacatgtggcgaacgcaatacagtatagacttctctttttgtaggcagaggaattggtcctacaacacgagctcctgttcttttagcagtttcaacaatatctgctgtggaacgatctagctgcccctgatcgaatcctttcagacgaatacgaattttttgcttttgctgcttcatacatcccttacttcttaacaatctcttcttgaattttttgaggaaccttagcaaagaatgctggttccatggttgatgttgcacgtcctgaggtcaatgatcttaaagatgtcgtgtacccaaacatttcgcttagaggtacctcagcattcacttgagccattcctcgagaagattcttgtcctaaaattttgcctcgacgacggttgaggtccccaataacatcgccaagatgatcttctggggtaattactgctaccttcatgattggctctaagattacgggcttcgcttttctacaggcgtctttaactgccatagacccacagatcttaaatgccatttcactagaatcgacttcgtgatacgaaccgaaaacaatacttaccttaacgtctacaagaccgtagccagccaggactcctgtgttcaatccctcttctatccctttaattactgcagggatatattctttaggaatgacacctccgacaatcttactgacaacttcgttgcctttcccaggttcgttaggttctatttcgaggcaaacgtgagcatattgccctcgaccaccagactgcttcacgtattttgtttcactatttccgctcacagtaatggtttctttataagaaacttgcggttttcctacgttagcttcaactttaaattctcggatcatacgatctcgaagaatatctaaatgaagttcccccattccagaaatgatggtctgtcctgtctcttcatttgttgagacacggaatgtaggatcttcttctgataaagaacttaatgcttgagcaagtttttctctatcccctttagactttggctcaatagccatatcgatgacggggtctggaaattctatacgttcaagaacaatttcttggttatcgtcacacaaggtatctcctgtgacagaaaacttcagacccacgcaagctccaatatcgcccacagtaaactcatctctatctgtacgctcattagcgtgcatttctaaaaggcgagaaatccgttcttttttatcttttgtagaatttaaaatggcagacccttttttaagagtgcctgaatagattcggataaatgtaatccgacctacgtagggatctgtcatgattttgaaagctagagctgctagaggtccatcacgtcttggctctaaactaatttcttgatctgttttaagattgattccgcggatatttcctcgatccaaaggagaaggcaaccacttgacaatcacattgagcagttgttgcacacctttatttttaaaagcggttccgcagagtacaggattgattttattctcaatgactcccttacgcataacctgatggatttcatcttcagtaatgctatcgggatcttcaagaactttcatcatgaaagcttcattactttcatctatagtagcgagttcttccaaaagattcgctcgcaattctgcacaacgctctttgagatcttcagaaatctctttttcttcccattttgctcctagggtatcatctagaaaataaagagctttttgagagattagatcgaccatgccgacaaactggctttcagatccaataggacagtggacagggaaagcattcgctcccaatttctctttcatggattccacggcagcaaaatagtctgctcccatacggtccattttatttacgaaagcaatccgtggaacaccgtatttatctgcttgtctccaaacagtttctgattgaggttccacgccagatacggcgtcaaatacggctacagcaccatcaagaacccgaagagaacgttctacttcaatcgtaaagtcgacgtgtccaggagtatcaataatgttgatttttgcgcctagccagaagacagtagttgcagcagaggtaatcgtaattcctctttcttgctcctgggccatccagtccatggtagctccgccttcatgaacttcaccgattttgtgagttcttccagcatagaaaagaattctttctgtagtcgttgttttcccagcatcaatatgagccatgatgccgatgtttctaattgcacttaaatcgaattcttgattgctcatgaacttgttattttctccgtaatttaactaatcttaccacttataatgtgcgaatgctttatttgcttccgccatacgatgggtgtcttcacgtttcttaattgttgcaccctgtttgttgaagcagtcaatcagttcggtagcaagtccaacttccatagactttccaggtttactacgagcgtgtttgatgatccattgcatcgctaaacaattcctacgttcgctagcaacttcaacaggcacttgataagtagcgcctccaacacgacgggaacgaacttctaaaataggttttgcattttctaaagcttctccaaaaccttcaagcacattctctaaatttaattttttaccgaaacgctctagagcagagtagacaattttccttgccacacttttcttcccatgcatcataaccttgttgataaatttttctaagatcacgctgccatagataggatccccagggatatcgcgcttttcagcggagtgccgccttgacatatacatttacctctatcttataaatctcgaccaagaacttcgtatgattacttaggccgctttgcgccgtaccgtgaacgactttgctttctattttttactgctgcacaatctagggtgccacgaacaatatgataacgaacaccaggcaaatctttgactctaccgccttggatcaacacaatgctgtgctcttgaagattgtgtccttcaccaccaatataggcaatgacttcctgcccgttagatagtcgcacccaagcaactttccttaaagccgagttcggcttcttaggagtttttgtttttacttgaaggcaaactccccgcttttgtgggcacttctgcaaagctggggatttctttctagctagacttgacttacgtcttttacgtattaattgattaatggtgggcatgtattcttctcgtttcaacctcactactacaagcatggaaatatagagtaaggctctctttgttggcaagggcttattttcagatgaagagggaacgtatcctgcttgaatttaaaaaaatgctatctttttctagacgaaccgtttttttactttttaaaagaaattttagctgtaacgaacttattctaacctatctctttggagagaagaatttcgtattaggtttctcctaatgaagactgtgcacaattaaagcagtattccatagagccgcgatttatgtaaccaaagagaaatcctaaaatgggctctgttaaatcttggttataggtaaaactactttctttgccttgttctatgatgtgaatagaatcgttggtataaataaaaagcaaaggtacggtgtgggaaagcaattgcgtagcttgagctaggtctgggatgcccgcaagaattttagcggagtcttcagataggaaaagaacttgaacgtagtttagaagagaccaaaagcgaccgaggaacgtggtcacgacttgtgagtcacaaagatcaacaagcgtgtggttattctttcttttggtctctttcagaaacttttctatactatccccgtagagaatcaattgcccatccaggagtgtgtatccctgattgcataggcaagtatttgtttctatgcccttttctgcttctttttccgagtagagcagggtatctggttggttaggacaacgtaaaactaatcttagatccttgggttgttttagagcgggtccgttttctttatttgccattccctcagcgtaagtttctccgttacgcatacataaaatacctaaatcggagagatgggattgggaaaggtttagaggttcttttcgtttgaaactgatagaggcttctggaaatttttccttatatatcaaaaaaatttcttttatttttgcgttattagtcgaagaaatggttcctatttgcaggccgcactgggcaacaaagtcctcattcgttgtgaggataatatctatgaaaggaatccctagcactgttaaacaggtcgatgtttcccaggagaagctttctgaagctcttagagggaagacggctcttcccaagataaaaattataaggaatctgaggacaacgcgccacatacaacctcagtaaaagtagaactcctattactaaactaaaagtaagactttattttaagtgttttcttaccttcttctttgtataatacttgtttatgtacggtttatgtacgaaggaaaatcacgcatggcatcgcccactccaggacaattgcatctacagcaaaaagtagaatcaaaggcctatgactattcacgcagcctcgctatgattgctacagctttgttattttttattgttgctcttattctttctggattgagtctgcttcctcaggtcttcctccccttttcaggagcgtattttattatcggttcttttttagcttttattgcgttagggattcttcttattaattgcgtctgcgatctcaaacagtaccttacctcgtcttagtttacaacctcgcaaagcttcttttttttattacaaaagttttttcctgactaagctgtttgtaataaattagtttctcacatctataagaaatctgtgctaaagcccttgggcttcgtgccgatgttacgaatatccattaacattaaatagatgttcgtaatgaaaaaacttgtccgtctatgcgtagttcttctttctttacttccgaatgtattattttcttcggatcttttacgagaagagggcatcaaaaagatgatggacaagctgatcgagtatcatgtcgatgctcaagaggtttctacggatatactctcgcgttctttatctagttacattcaatcttttgatcctcataaatcttatctttcaaaccaagaggttgcagtttttctacagtctccggaaacaaagaaacgtctcttaaagaattataaggcaggcaactttgctatttatcgcaacatcaatcaattaattcatgagagtattcttcgtgccaggcagtggagaaacgaatgggttaagaatccaaaagagcttgtattggaggcatcctcatatcagatatcgaagcaacctatgcaatggagcaaatctttagacgaagtgaagcagagacaacgcgctctactcctttcctatctttctttacatcttgctggagcttcttcctctcgttatgagggtaaagaagagcagcttgctgctctgtgtctacgtcaaatcgagaaccatgagaatgtatatttaggtatcaacgatcatggtgttgctatggatcgggatgaagaagcctaccaattccatatccgtgttgttaaagctttagctcatagcttagatgcacatacggcgtatttcagtaaggacgaagcgttggcgatgcgaatccaactagaaaaaggcatgtgtggaattggtgttgttctgaaggaagatattgatggagttgttgttagagaaatcattcctgggggacctgcggctaaatctggggatcttcagcttggagatatcatctatcgggtggatggcaaggatatcgagcatctttctttccgcggtgttttagattgtttacgtggaggtcatggctctactgtagtcttagatatccatcgtggggagagcgatcatacgatcgccttgagaagggagaaaatccttttagaagaccgtcgtgtggatgtttcctatgagccttatggagatggtgtgattgggaaagttacgttacattctttttatgaaggagaaaatcaggtttctagtgaacaagatctacgtcgagcgattcagggattaaaggagaagaaccttcttggattagttttagatatccgagaaaatacgggtggatttttatctcaagcgatcaaagtttctggtttatttatgaccaatggcgttgtggttgtatctcgctatgctgatggtaccatgaagtgctaccgcacagtatctcctaaaaaattctatgatggtcctttggctattttagtatctaaaagttccgcatcagcagcggagattgtagcacaaactctccaagattatggagttgctttagttgttggagatgagcagacctatgggaagggaacgattcagcatcaaacaattactggagatgcctctcaggacgattgttttaaggttactgtagggaaatattattccccttctgggaaatcgactcaacttcagggagtaaaatccgatattttaattccttctctctatgctgaagatcgtctaggagagcgttttctagagcatcccttacctgcagattgctgtgataatgtacttcacgatcctctcacggacttggatactcaaacacgtccttggtttcaaaaatactatcttcctaatctacaaaagcaagagactctttggagagagatgctacctcagcttacgaaaaacagtgagcaaaggctttctgagaattcgaattttcaggcatttttgtcgcagataaaatcatctgaaaaaacggacctatcctatggttccaatgatttacaattggaagagtcgataaacattttgaaggacatgattttattacaacagtgtagaaaataattactgttgctctttacatctgatctcgtacgtggaaagtagcatcccaagttctaggatgcttgtgagatgaacgtctaaacgcgagctattttacttactaaaggtgaaagtacaggagttccgcggccatcattaagtactggggtagtagccctagaggtatttccttctgttttcacatggccaaaaatcttatttgagttattaaggatcccatcatcgagctgatcttctaaaacacctgcccatttttggaaaaccatgagtttttcagatgtacaagcttcatcaaaacataatgatgtaactagtaacttaatcaatcctatggcagcaggaataatcaaccaaaatgcatttgcccctaactggctatggaagataaacatacatgctaatccagcaacaaccaaaagaattcctaaaacgagcagggtaatttggcaagctctggattgaaagagctttgattcacgtataggttgaataaattttgtctttgcccatcctatgagtagattcaccattcctggactggacgtaattgcttgtagaccagcggtgacactccccgatgctgctatttcctctactatgtttagcacagactcaggagcagctgctcctgttcctgttcctcctacgggatgtagatttgatgacataccgttctcctagtgtagttcctaaagaagcaggttacactaggaaaacattaattaaaaattttaattacatacctaaaaagatgggcttttaaaataaatcttaggatttcagaaacttaaataatatctttgattaagaaactctacgattggattgaagagcttataaaacaaaaaaaccgctttagtacgtaaggtactaaagcggtacttctttgaaagctatcctaaagcagagcggaatatcgctctgctttaggataattccttagaatttaatacacgtgggtattttctgtgtctgatactggtgaagtcagtgtatcagaagaaagaatagcttcgccgcgagcatctccgggagcaatacctttcaaggtaacagaaaactctacagattccttagaaccgagtttaggtaaagcgtcgaaaacaacggtattacctgaaatcgttcctttagttggacctgaagaagctattggctgaagttcttttgagaacttcaagattaaagatacgttagtatcttcagcagaaccacggttagttacacagatacgatagacagtattttctcctacacagataggatcatttgtgtctaatacgcacatatgggtagctgcaagacctttccaatgtgttgttgtttctgcgcaagatgtacatgttccgcagttagactcactagttactgcaacttgatttgtgaatcttccaggaacttgagctttcactacaagtttaaactggagggtttctcctgggcacatttctttaatacgccaaacaactttattacagcagatctctccaccaggagcttcgagtactgtaacaccagaagggagtgtatcttggatcacgacatcatgaagaaccaagtctccaggattcgatactgagatagagtactccacaggtttacatacgtaagaccaatcagcaccagagatatttacttgtacacaaggctcattaacaactgtagttacatttgcagaacatttgtgtccaccgcagtaagttacagtagcaacgttagtgatttgacctcttctttgagggcagaactcaactgtaaatacctttttatcgccaggtctcatgtctcctaagttaaaagagagaactctttgaccagatgcatgagaatagccatcgggaacaggattatctacagttacgttacgggcaatagcagatcctgtgttcactacttcgattttgtagcatacagggcatcttaggcaagcacagtcaggtccttcttgcttaatacaaatggctggttgaccgcatttagtataagaacggagctctgggcaagcacatacagtagcagctgtgaagcagcaaccttctttaagaggttttacccatacagtaattttgcatttatctcctgcacccaggcgatcgattttccagactaatttcccatcacttgtaggagttgtttctggatcactgcttacgaattcagcttcgcaaggtagctgttgtgtaatcacaacatcaacacaatcttttttgcctatagcaaggatttcaatagggtaaggagatcctacagtagcgtattctggaacggactggcaaatttctacgttgcaatcatcgtttacttttacagaatacaatcttccgtagcaagactcttgctgagcctctacaggttgacatcgtccctcttcacagggataaaattctttatcacaaaaagcaccacggcttttttgttcaactggttgtttatttctacggacaagtctaaccttcttcgctgtcataggaacaggtgctggctttgtttccgcactagcgacgatcttagtaatcagagactctgctacagcggcctctatacccccgctggcaaagcaactcgccatactcgttagcgcaaggaccgtaactactcgtctgatgagtttggacatagggatctcctatcgcatgtttatttttttcttctgccatcgggtagaatgttttgtaaactcttaccctcaacatttgggtttattatctgaattaaggtagtcaggaattaattcatctcctaactacccgatcaatttaagtaaacagttaagagaactctccttactgtttgcatctgccatcaggtgatgtacaacctttaacttgtgggctttgagagttacactctgttgaaccacatggattagaacaagaaggaacgtaggacccacaagcattaccgccgcaagatctttctttttttcttattacttcacaaggattgcaagaagagggtgcgcaaggatcctcaaaacaacaatctacaatgcggcagcagctacttaagctaactactccacaaaacattgcagcaattaaaacagctttcttcataagtttttaactcctttctaattagaaaacttacgtgtcttatttattactgaaaattcaacaaaacttttaataattaataaagcacgttcccatgaacaatattacaaatgaaaataaaaattttatcaattattttttctagataaatctttttggtattaaaactctttttagaaaacactatttactaaaagataaacctataattttcaaaaggaagcgtcatcaggaatttgaggaaactgaagaataaaaagaataatttgtttaataactaatggtttatttcacgagactttttcacttattttctatattaaaaacacataagattcacaatcaacgagttgaagtagaatgattgttaatccgcacaatcaaatcattgaattataacaaaataatttcgtaacattaaaaaataaaaacgagggggaaatgaaattattttacttttgtaacattattttcctgacatctctattttctgtaagctgcacgcacacgcctcctccacgtagttatattcttgctcaaggaagaacgcccctcgtcaataaagcgcattccttagaattctttttagcaagatctgtctttaacacgtgttataatacgaacttatagcctcacaaatcacgatcaagagagaggaacgcaggactactctgggatagagctgcgttgtagattgtcttcgcaacgactcaaacaggaagtgtggttatgaatagaaaccgcggtggctgtttcgcttagctagcagccacgcacattcatgcgaccgatatttagagatcgaaagtagcctcttcgaagtcttctcgttgcatgaacttatccacagttgcagcgagcttcttaggaacgcctcctaaaagcttttctgcatacacaagacgtgctctcgctcgaggtttccctaaaatctctatagagtcaaagagagggagcccctgctttttcccagtaattgccacataaagcagtgggatgatggcttttttatggtggacattgaatgcttgagctaaccatttagatccgaggtaacacgtctctttcgtccattgatcggttttctcaagatatttgacatagctatagagaaggatagctgctttctctggagaaagggcctgtggtaggagttcctcaacacggtactctaacaatcctgagaaaaagaatgaggtgaggttgataaactccgcaagagttgtaatccgagattgacagaggggaaggatttttaagaaaaattcgtcattaagtagccaaccctggagttcttttaacaagcactctggcgaaccctcgtggttgaggtaatgcttattcatccagtcgagcttttgaatatcaaaaactgctcctgactttccaatacgtcgaggattaaaagtttctataatacgctctagagaatagacttcttcatccccttccatactgtaacccatgagagtcaggaagttcacaaaggcttctttgacataacctgagtcgcggtaataaaaaatcgaggtagggttctttctttttgaaagttttgttccatcggggtttagaagcaggggcatatggagaaagacgggaggctcccagccaaaagcttcgtagagtaggagatgcttaggagttgaacttagccactcttcccctctgaggacgtgagtgatgcccatgaggtggtcgtcaattacattagcaaagtggtacgtggggaatccgtcagattttactaggacctgatcatcgacatctgcccaaggaaacacgactcttcccttgctataatcttcgaaaacacattcccctgataagggaactttaagacgaatggtgtagggctgacctgctgcctctcgtgaggctacctcttcgggagagaggtacctgtacctgcgatcgtatcccccacgataaccgagggtacttgccacagcgcgcatttctgcgagttcttgaggggttgcaaagcacttataagcgcaatctgtctttaaaagtgtctcaacatacccttgatagattttcgtgcgttctgactgacgataggggccataggggccgcctacatcagggccctcatcccattggatcccgcaccaacgaagagctgagaaaatattttcttcgtaatcttggcgactacgtgttctatccgtatcttcgatacggaggatcattttccctttaaatcgttttgcaaagatttcattaaacagagccatataggcggtacctacatgaggatctcctgtaggtgaaggagctaccctaacacggacattttcccaattcatgattcttttatccttagaccagagagacttcataccctgaaaacggctatttcttcaagggaaatcctctctgcagaaatgcataaatccaaaaataaaagaaactccttaatttaataaaaaattaaggagtttctcaaaaaaatcacgaaaggatatttcgccacccttagatcggggatcgcctttaaagtatcagaaagaagtagttaatcaacaatgttgtaagtagaaaatcgaaaaatcgagagcgagttagttagattcaggaaaaatttcagtaggaggttcgaaatttggagcctgatgttctttcggttcagctccttttagttttttagctgcttgcttactcagatactcattcttatatctttcaatctcagatacgtgaattacccaagcggctcccttacgctctcctcgtatggttcccgtacgagttgcatagtagaccttctgcacaggtattcctaaaatctgagcaacctgatttatggagtagcatcctttaccgttatcgaaaacaagctctccttgataaagagatttctttcgagagtaacggttacgtttgtactcttccaaatctttaatatctatttcccagcgcgtctctttagaagcttttagttttttctgcttaattgccacataaattgcttgcctagtgacgttatgtaatttagcagcttgagtgatcgaaacccattttgtatctgagtctttgatatcctcaatttcttctctttcttctaattcgtagcatccctcatgttgttcgcacgccataagctagcatcccctccccctcaacatatttacaattaaaacaaccgtaacagttagtttcttccttgtttttagaagtttttaaagaagcattttcctaaaaaaagctttattaatcaagcttttttgttaatacaaagtttatgttttcagattaaaatcttaataaatcgtaagcaggattatgaattattaatatttctttacgttataaaaaataggtattcttaaaaaaacacgccctgaatatcgccagggacgtttttctaatcataacgtttttcttaagtagacaagacaaaataccaagaaccaacaaaatatctactctttttcttttcctgaacgaagtatttttttttaattttccttatcggtcagcagtttacagaagccagggataaggaaactacaaagatttctttactcttttaaaataaagctctcgatttttgatttaaatctgcgatgaaccttaggaaactcatttttggtttaaaagatgagtttctaattatcgaaatgtctttgaatatgacctgcaacttctttaatcacatcatcggaaaggatatgatcgtgtcttagaccggtctgagctacagggattttcttccctgaacactcttccaagtttttaggatctaaaaatggtgctgcgaagcacgtctcttttttgaacaatccatccccgataagattaccttgggaatccttgccataaataaagagttctgggcaatgcaagtccttgcttctcttttcagaattaatattccaatgggtaagattcgccagccaaactcctagacttccaataaactgtttagcaacggctcctgtagagcgagctcctcgatctttaacgacaaaccaacggacgctatcacttccgtctgcgatctctttacttaatgcttcggcttgaacactagctcctaaagaatagccataagcaacgatttgacgcgcctgaggtcctgcgggttcatctctaagatagcgtacgcatgcttgataagatttgactacattgtttcttgttatattcccttggctcttcatgactcctgggtaattgaagattaaaatgttggattgagactcttcagcaatacggaatatccagtccttttccccttgcagcactgtcctatactctaagcaatcggagtttccattggagattaacatccatcgatctggcttagcattgggaagacgtaactccaatccgtcaataaagacctcgtcatactgtaagcaaacccttcgcacagaggagacatgatcttggaatgaagcggagaaaagacgcgcggcgtaagcttgtcgcaataaattagagtccctgcatatgggtctaaaaatccaccctcctgcaccaagaagaataaaattctgacatatcttctgaaggacccagaaaagacccaagggaataaagaagattaagccgagaagaaatttcacaacaccccatatgatctcaagaagacgataaaggtaaggatgagcctgtcgtttctcccaagaagttctcgcctgctccgaagaaaacatggcgatcgaaggtttaggatgcatatccaatatagctgcgtattgttcccttgcaatagctattgacattattaccttataatttcatgcagaatgtagtgagcaaactattatagtggaaattattgaataaaccaaaaacaaaagccgagtttatttatattaatataagtaattattttaatagaatcgacctcgaaccattagatagataggtgacgaccttcatctagaaaagaacattcatttattatgataatgaagtaaatcttttacttgcaatgaacaaagaaccaatcgaatgaaagttagcggtctttttttagtctgaaaatctaggttctgaggaaatacggaaatcccggaccagcaggtggatgactcccgatccagaagtttgggacaagcggggtgtgtaagcaatctcaagagggtaatgccaacttgcttttaatgcatcagcgtgtcttcccagaccgaaggcgacaccctcaagatttctttctttttggcttaagtagagtttgagatggtttccaggcaatacttttggatagcgtacctggcgcacttttgaatagaagataggcatcagattccccttcccaaaaggctcgaatagttccatagaagctaggagatcataatctatagcatcaaaatccgcataagcatcaatttcgagatgaggaagtgtgtcaccctttttaagagaagagttcacgagatgaacgaatttttttttaaaatcttcgactttatcttccttcataatcacgcctgctgcaaagtcgtgtccgccgtaagataaaaggagcgaggagcatttctttaagactccgagtagaggaaatgaccctatagttcttgctgatccctttccaattcctcgttggatagcgatgattaccacaggtttgttataagtcttagcaagacgcgctgagataatagggatgacacgagcatgccatgccgtggatgaaagaactatagcagcctgctttaaaatctcaggattactatttaatatctcttggacatcttgaaatacctcagcttctattctttgcctttctctatttatattatctagctccataattagagcatctacacgttcatcatcttgggtgagtaaaagttcaacaccttttgcagggtcgtccaaccgtcccaagctattgagttttggtgcgatcttcaagacaatatctgtcgaagtgacttcgcttttttctactccacataatgcgcagagtttattcaatccgggtcgcgcgcctctggcaatttctttaatcccatagcgcaccataacacggttttcccctagcaaaacaccgacatccgtgatggttcctaatgtgactaaatcgagtaattttttcaggctaccttgactcttggggacaagatttctggatatcagtgcgttcagtactcctcttgcgagcttaaaagcaacgcctacgcctgtgagttctcgattcgggtaggtatgatcccgtaatttaggatttaatgtagctacgcagtggggaatttttcctgtcggcatgtggtgatctgtaatgatcacatcaatgccttgtcttgtaatatcactcacctcttttcctgcagtaattccgcaatctacggtgatgaggagtgtaattccttcctctttcaactttgcaatgagtgtggaggtctctccatgttgcttgagtatcgcaccaagaaagaagtagctaacgtggacatcaatatctcttaaaaattcgaccaggagagcgacgcctgtcatgccatcgacatcgctatctccataaatcatgacgtgttctttacgatctctagccaggagcaggcgttctacagcctttgacatatctaggaagagtccaggatcataaaggctcgacagatggctgtataagaacttatggatttcctgaatcgtttggaatcctcttgagataaaaatctgagccactgtgggaggcaagtgaaattctttgataatcattccaagaaacgcaggatcttccttgggatgagcccagagcaatcctgctgcagaagcattatctgaatttgtcataaatttaataccacaggggcctttgggactaaagtcccaaaggagatttttatattgctacacgttagattaagtttaacggtacttattttgagcgattttctttacggaccataaacaacaacagaggtggtgcaatataaagagacgataaagttcctagaagaatccctatggtcataataaatgcaaaattaaagacagaggagccgcctataaacaaaagcattaacaaaactgatagagttgtagctgttgtcattaccgtgcggctgaacgtcttttgaagggcatcattaactaaaacatgcataggggtaaacaggttcgcttggcgatcttcacgaatacgatcaaaaatgatcaaagtattgtttaatgaataccccaatacagtcattaaagcaccaatggcttgcaaatctatttgaattttcttcaaaaagaaatgtgctataaacaagactgcacaggtagccaaaaggtcatgaattaaagcgcatacggcactgaaagcatattgccattcaaagcgcaaactcacatagagcaagatgattgccaaagctcctaaaagcccgatggtcgcctgataacgcattttcttcgatagtttgctgcttacctttgaccaaaaattttgcgtttcgtttagagtttccgtagagaaatctaggcctgtttctgacaacaatcccacagctaacgccagctcatgatcgttaattttaggagagaggctcgtatctgctttagtatagcttaaagctttatcactaaaatagattttgatcttttctgaagatccaaatgtttgaatacggaagtctctagaagaaagaccagcttcctgtagtttatgcacaactttgccacgcatttgagcaacatcgctgatgccatgctcttttggattaaaggtaaaggcataccctcctttaaaatccattcccaaaacggaattccaggctccaaacccgagagcaacgcaacctaaaagaaaaacacttccagaaacagcccaaagttttttgcatcctctcaagaaatcatgctttatccccacgaacttattcatcatatgcaactgtgtatgttgggtcttattcatccacagcatgaagaaaaatttagtcatgaaaagagccgtaaacattgaagagaaaattcctaaaatcaatgtcaaagcaaaccctttaataggccctgtatctaggaagaaaagaagtgctgaggccaatactgtagtcaagttagaatcaaaaatggctccaaaagccttggtatatcctttttctacagattttttaagactttgagacaataaaaattcctctcggattctttcgaatacaagaacatttgcatctacggccatccccatagcaagaacaatcccagcgagtcctgacaaggtgagtggcgcatccaaatactgtagagctgcccagataagcaaaagattcagaagaacagctcccgaagcgatgacgcctccaaatctataatatacgctcatcaaaacaataagcattgccaagccacagcatgctgagataatgccttgtgtacattgttttttcccaagatcagaagagatcgtctcttcactgagaacctcgggaacaaaagacatcgctccagattttaaatctgaggcgagtttgctcacttcacggtgggtaaatttccctgagacactggcatgatttttcaatgggacgtttaaaatagggctgctgaccatataaccgtcaatcactacagccatacgccatccacggtttgcagaatattgtccattagcagtgccgctgatcccctcctgacaatatgcggaagtccatgtgtggaaactctctgtaggagaaagtttctctgccattttcttagggcttgtatctttgactgaaaaatttaaaacataaccttcccctgcagcaaattctggacgaatgtcttttagggaagctccatctaacgcataatttctaaaaacaatgactaaaggatttgctttttgttctgcatcttttccaatagcaatcatagaaaacgtcgtatctaaatctgtcgaaggcgtttcgcatcctgaaggagagaacgccaacccctcacttttaagcttagtaatggcctcatggacacttggaggcacatcgacttcctcattaaataaggcgctagcgaaggtattgatttcttcgggagatgtctttccttgagcttgagaggtaaaccaaagatagtctaaaaatctttgcacttcgtagcgggaagcgctgtaagaagagaacctctcattcaccacatggaaactcatttttgaggtccccaagatctcagatgaggagatcgtagaagatcctggcacactgagatgaatgtaatctccctcacggcgaagttcgatttcagatactccaagtttatttaatcgagcacagagctcatccgaaactttaagaatatcttccttatcggtgagctgctttccctgatgatctttaaaagagagtagcagctgacgcccaccaacaaaatcaataccaagacgtagtatgttctccccacgagaaaattttctcatgttgagtttcatattttctaagaaaagattttgataaggaatcggagcactcaaacgttcctgaagatccatagaacactttgcgtgtcggtattgctcatgccaacgcactaaatcgctttgacgattcttctcgatttggtttacagttgcaaggcgatcttgaatgtctttaacttctaaaaaggcacagccctctttccctatgacaaatccctcaccccatacatctagaaattgctgcaaggggtgccggatttctaagacttgatcttctcctagagtccaggaaatcgcttctgtatgagaaaaacagttatagagattttgtagatctttttcgaaactttggagttctttaccccctccctgttgatatttcgcgacgatagaacggagtcctttcaataagatgtaaacggagcctttagaaaagtgtttgcaatctgtattgggagaaaagatgtaacagccaaaagcttcgctttctctaggttgacgacagaaaacaggaaaattttctggaatcaggtcacaagattcagctgcaggcctatgcaaagttaatgccgtgagatgttctgcgattccttggagcaaacgctctccctggagaataatctttccctgagtatctttatccatccattggaaggaaaatccgttgttataatcttctacttgaacagttaagttcttagagagcttttgtttttcaacagccaaacgactgtcaaaatctaagcgttgttctttagacaaagacgtacgctgtgctaacaaatcagaatgtagtgtcaggaaaattttacgttccttagggcaatactctatggaactaaaaaataatgaggactcactacaatctaatcgaagcccttcaatataagggcaatctaaactacgaatgcatgcagtttgagaaagagtttcatacacactcttgagtagcttttgatcttcaacatcgattgctgcgtcgtttgacaacgaagacaggcgtgataaaaacgcaagtctatcttggttggaagaaaaggactgttggcaaaacgctgaaagtcgcgaagaaaaaacctcaaatcctgaagaaaggttcttggcatactgtaacaattgttctttaggtgccgtttcccagatagaggggtaactacaagaacagtctttttgtttcggaaaagtacatgcagaatagactcgttgcaaaatacttgaggccatctcttgttcattttcggaagaataggaaacaaaagaaaaatcactttctactaaggaagtatttatagagcttgctacttgtattacatggtcgtcgtgttctcgactatagccaaccacatggagtcttgcagactttatgggaacgttaggctctccatgaacgaggttcccgataaagtcctctgcatcttcacctcttttaaaacgcacactgacaatatctggaatcgcaggatgttgttgtatgtgcccacgtaaatgtagggacgaaaggatcgctgagacgcgaggaatgacatccttacgaacttgctgggcctgcttggtaaaagatttgattatatgttcggcttcgtttccatctattttcttatccagaggtttggcgtaatataaacatgtaggcaaaacgtaatacaaagccaaagcaaacacgcaaataatgatagcgaagtttcgcttaaccttctgtttcattgcaccgctctactttttattaggaaatattaaaaccaaaataccagttgaaaaaaaaatcgtcaaacgaagaggagccctccaccttcaaagagagctctttattctgtatcttttacaaaatactatttttaattttcctaaaatctctatctcaaaagggtcaaattcaataaaaactaggcaaaagtatagctctcttgttcgccaacaaaaccagaaagcgaaataggagttacactatgcggggttgaggagtgatgaggggaaaaatacagtgaggttgggcttgtgggatctgtgaaaataaactttatccgaatggaatcttgtttctcttctctcattcgttttgccacctgctctgcagagtagaggaaagcggcttgtgagagcagttttaggttttcctgttcctctttagggagtgcatcaggaactccaaggataggagtgagtacgtagatcgtatgttttttcactatattaggatcgccgatttgatctaacacagtaaaaaatgctttagtataggcatcgatataacatcttccctgaggttcctgggctgcgtcagaaatatttacataaatcgcgcttttaggatgcgtgcggtcactagcttggtcttctgagctccaggaaatgactttaggatccaaatattgctgttcctctctttggatttcagagagcaacgaagacactacagaaggatctatagcaaaagttttgcgtgataaggagcttttttcgatcccctgtcttaatgcgatctgatccatttcttggatcagaaagatactggtatttctatcggattttttctggaatatcttagtaacgatctcctgggagccttcgcagatctctacttggggacagcctggatgatagtagcatccgggtcgtatttttttccaagactgcaagagagagaggcatcctaaccaatttataggtttttcaaagaccttagtttctcgaaatagaggacgctcgaatcgtgaccatcccttagagtattgtaagtacgcaaaccctaaaagaaccaatcccagaatcataagacctatgcacgggaaaatggtttgacataccccagcagcgaaggcagcacatcctaacaacgccaaaccaaaacaagctaaaacaccgcccagtattttcttcggcaggttttgtgcattggggacgtagtggacattgcctcctccgcgccaccaaatgaccatttgagtgggaatcaaatctgaaatggatatgcgaggaaatttcatactacgaagcatccttttagaatttctttttatttttaataaaaaactagaatcgaatagaattgcactaatattaacaaaacaaaaaattaaaaaacaaaagagtttgtttcaaaattttcattgaaaaataaaaagaacactaaaattgtttcgactttgaaaaaatgaatgtcaacttgtcaagatattctagtttcttctactatgcaacctaatattttctactcctttgctcgtcatgagtaagccgagtatacttagattaggaggatgcctaagaagcccttgtattcatttgaagtaagaactctcaaaaattttcttcttgagacaccgatctgcttagagaatagaatacagcctctccctactgggatggctggggaaaaatcctttgtgatttttgtcttaggtaagtgaacgaattctcctttcttaaaaataggttcgaaacgttgttcctgagaacgaattgtgacttacgccctaataaatgatcctgtagacttgtctttagctaccaacaatgctgaatccaagttcccctctctacagcgccttcccaaccatgttgctatcattatggacggcaatcgccgatggtacaaaaagcatagggaggagtgcggccacacacacacgtcaggtcattattatggcgctaaagtccttccaaatattttaaatgcggttcttgatttaggaattaaagttcttactctctatacgttttcaacagaaaattttgggagaccaaaagaggaaattcaagaaatatttaatattttctatactcagttagacaagcaacttccttatctaatggaaaatgaaatctgcttacgttgtataggagacctttccaagctccctaaaggcatccaaacgaaaatcaaccatgtgagtcgcatgacggcatcgttctcgcgtttagagctcgtattagctgtcaactacggtggcaaagatgagttagtccgtgcatttaaaaaattacatgttgatattctaaataaaaaaatatcttctgacgacctttcagaatctttgattagctcatacttagatacttcaggacttacggaccccgacttacttatccgtacagggggtgaaatgcgtgtcagtaatttcttattgtggcaaatagcatatacagaactatatatcacggataccttgtggccagattttacgcctcaagatttgtttgaagcgattaacgtataccagcaaagatcaagacgaggggggaaataggtgcttaattcaaataagtttaaatcgaagaccggtgcatacggtgatttatttcagcgtgttgttgttcattcgttagtacttacatttttggttcttcttctctatagttccctatttcccttaacttcttttgctctagggtttattaccgcgacttgtggcgctgtaggaacttatgagtactcctcaatggcgaaagccaagatgcactatccattaagcacgtttagtgcgatcggatcttttttatttttagcattaagttttctttccattcgttggggacacagtctcccaggattcttcgatgctcttccttggaccttgcttattgtttgggtcgtgtggagtatctttagagttcgaaaatctacaatcggcgctttacagctatcaggagtcactctcttttctattttgtatgtagggattccgatacgtttattcttacatgtcctttatagctttattcatacccaagaaccctatcttggaatttggtgggcttcttttcttattgccacaactaaaggtgcggatatcttcggttatttcttcggtaaagcctttgggaataagaaaatcgccccacaaattagccctaacaaaactgttgtaggttttgttgcagggtgtttgggagccacgctcattagttttattttctttctacagattcccacgaggtttgcgagttacttcccgatgcctgcgattttaattcctttaggtcttgctttaggaatcacaggattttttggagatattattgaatccatatttaagcgtgatgctcatttgaaaaatagcaacaagctcaaggctgtgggtggtatgctggataccttagactcactgctcctgtccacgccgattgcttacttatttttgctcataacccaatctaaagagtttattggatgattatcactattgatgggccttcaggaacaggaaaaagcacaacagcgaaagctttagccgaccatcttcatttcaattactgtaatacagggaagatgtatcgcactttagcctatgctcgtttacaatctccctgggcgacgcttcctttaactaaatttttagaagagcctcctttttcttttacctttgctacaggccaacctttagagtcgttttttaatggtcatcttcttacctctgaattaacaactcaagaagttgcgaacgcagcatcggagctctctcaacttccagaagttcgtgcattcatgcaagatttgcaacgacgctatgctcagcttggcaactgtgtatttgaaggaagggatatgggatccaaagtctttcccaacgcagatttaaaaatttttctaacttcaagtcctgaagttcgtgcgcaacggcgtttaaaagaccttcctgaagggactctttctcctgagcaattgcaagcagagcttgtcaaacgtgatgctgcagatgcacaacgcgctcacgatcccctagtcatccctgaaaatggaattgtaattgactcttcggatttgacaataagacaagttctggagaaaattttagctttactatttcgaaacgagctatgattttccgcatttgtaaatttttcacgtgggtagctttttctcttttctataagctaaaagtttatggagtgaaaaaaaattttattaaaggtcctgctattattgcagtaaaccataattcttttttagaccccatagcattgcacatgtgtgtccatgagtgtatttatcacctagcacgggcctctttatttaatatcccctggttatggaagcaatgggggtgttttcccgtgcgtcaagacgaaggaaactctgcggcatttaaaattgcctctcggctctttaataaacgaaagaagttagtgatctatccagagggggctcgaagccctgacggtcaactccagcctggcaaggtcggtattggtatgatggctgcaaaatctagagttccgatcatccctgtctatattaggggaacttttgaagcttttaaccgtcatcaaaaaattcctcatgtttggaaaacgatcacgtgtgttttcggtactcccatgtattttgatgatattattcaaaatcccgagatcaaaaataaagaaacctatcagatcatcacgaatcaaactatgaacaaaattgccgagctcaaagcatggtatgaatcggggtgcaaaggagacgtcccctaaacttatgtcgacattactttctatcttatctgtgatatgttctcaggcaatagcaaaggcatttcctaatctagaagattgggctccagaaattaccccgtctacaaaagaacattttggccattatcaatgtaacgatgcgatgaaattggctcgtgttttaaaaaaagctccgagggctattgctgaggccatagtagctgagcttcctcaagagcctttttctttaattgaaattgctggagcaggatttataaactttaccttctctccagtatttctaaatcaacagctagaacatttcaaggacgctctaaaattaggatttcaagtttcccaacctaaaaaaattatcattgatttttcctctccaaatattgctaaagacatgcatgttgggcatttacgctctacaattattggggatagccttgctaggatcttctcctatgtaggtcatgatgtacttagactcaatcatatcggagattggggaactgcatttgggatgttgatcacctatttgcaagaaaatccctgtgactatagtgatcttgaggatcttacgagtctttataagaaggcctatgtctgctttactaatgacgaagagtttaaaaaacgctcccaacagaatgtggtagcattacaggctaaggatccgcaagccattgctatttgggagaagatctgtgagacttcggaaaaagccttccagaaaatctatgatattttggacatcgtggttgaaaaacgcggagaatctttctataaccctttccttcctgaaattatcgaagatctagagaagaaaggccttctcactgtttccaacgatgctaaatgtgtatttcatgaagccttttcgattccttttatggttcaaaaaagtgatgggggctacaactacgccaccacagatcttgctgcgatgcgctatcgcatagaggaagatcatgccgataagatcatcattgttactgacttaggtcagtctctacatttccaactccttgaggctacagcaattgctgcgggctatctacaacctggaatattttctcatgtaggctttggccttgtcttagatcctcaagggaagaaacttaaaacccgctctggagaaaacgtaaagctccgagagcttctagatactgctattgaaaaagctgaagaagcattgcgagaacatcgacccgaacttacggatgaggcaatccaagaaagagctcccgtcattggaatcaacgctataaaatacagtgatctctcttcccatcgcactagcgactatgtcttttcttttgaaaagatgctccgcttcgaaggaaacaccgccatgtttctactgtatgcctacgtgcgaatccaaggaattaaacgtcgtttaggaatttctcagctgtcattagagggacctccggagattcaagaacctgctgaagagttgcttgcattaactttgctacgcttccccgaagctttagagagcacaattaaagagttgtgtcctcattttcttacagattatctttataatctcacccataaattcaatgggttcttccgtgacagccatatccaagactccccttatgctaagtctagactgtttctatgtgctctagctgaacaagtcttggctacagggatgcatctcttagggctaaagactttggagaggttgtaagttcttcctgttccatatcaaagatctgaattttagctccgaggcttctgagcttgcctacccaatttgtatatccacgatctagaagatgagtgttctcaataatagagcctcctccttctgcaatcagtgctgccatgacataggcaaatcctgctcgtaaatctggaatgactaaatgcgaggcccataaaggcgtcgccccatgaatcacagcgctgtgaggaaaattcccgatagcataacgacatgccttggtacttaagcactgatgaaaaagctgacactcagctcccatgtgctgaagaccatgaaggtagccgaggcgattttcatggacagtctcatggattactgaagatccctgagcctgtgatagtagaactgcgaagggttgttgccagtccgtcaggaaccctggatgaacatcggtttccaagacaacacctcccaccaaggggcgttcttgaaaaaattctattcccgactcggagaccaaaaatcctccgcctatggagcgcaacatcttgaggaagggaatcagaagttcttgtttagcatttcggacgaaaacacgtcctccagagacaaccgcggccattccaaaagaggctgcttcaatcttatctggaaggatggtgtggtctacagagccgagacctccagtgccaaaaatatctatcgtacgatcattatcggtagtgatatccgcccctgccttttgcaaaaagagcaccaaatctaagatttcagcttcgagagctacattttttataaccgttcttcctttagcatgaattgctgcgagtatgagattttctgtagcccctacagaaggatagggtagatgaatataattccctttaagacctcgaggagcctttgcgtagtatcccgaactatcagaggaaatctgcacaccaagttgttttaacccttcaaaatgaaagtttaaggtcctttctcctatagcatctccccccacagtgggaacatagacaccttcagggcaacgccctaacagcgctcctaataaaaggatggggatcctattgacatttgaaaatgtgggaggaactcttgtgcattgtatttcgggagtatagatttccaaaacctctgtttccttatcccaagaaacatgtgctcctagcgacttgcataactctacagttaaggaaacatctcctatatcggggacattccgcagtgtgcacttctgatcagaaagtaaagaagcaacaagcagcttagttgcagcattttttgctcctgaaacttttacctcaccattaagtctaccacaaccaaatacttgagcaatctgcattctccgttcccctttggcatcaaaatcactaaaagaaacgttaaccttctcgaaggtttattgccattcaaactttttccttagatcaaagttccttaattcaaaatgattaaaatattaaaacaatattactttgatcttttaaaaacaaaaacagagataaatataattaatattatttaaaatataattaatagaattaaaaattatttatttctcaaaatagattatggcagctcctatcaaccaaccatcgacaacgactcagataactcaaactgggcagactacaacgacaacaacggtaggatcattaggagagcattctgttacaacaacaggatctggggcagcagcacaaacatctcagacagtaactctaattgcagatcacgaaatgcaagaaattgcaagtcaagatggatccgcggtaagcttttctgctgagcactctttttctaccctccctccagagactggaagtgttggagctacagcacaatccgctcaatctgcggggctattttcattatcaggtcgtacacaaagaagagattcggagatttcttcctcttctgacggcagttcgatatctagaactagctcaaacgcatcttctggagaaacaagcagagctgaaagtagtcctgatctaggcgacttggatagcttatcaggaagcgagcgcgctgaaggagccgaaggacctgaaggacctggaggcttacctgaaagtacgattccacattatgatcctaccgataaagcgtctattttgaacttcttgaaaaatcctgcagttcagcagaaaatgcagaccaaaggaggccactttgtttatgtagatgaagccagaagtagtttcatttttgtccgcaatggtgactggtcaactgctgagtctataaaagtttctaatgcaaaaaccaaagaaaatattactaagcctgcggacttagaaatgtgcatcgctaaattctgtgtgggatatgaaaccatccactcggattggacgggacgcgtaaaacctacaatggaagagcgctcgggagccacaggaaattacaatcatctgatgctcagcatgaaatttaaaactgctgtagtctacggtccttggaatgctaaagaatctagtagtggatatacaccctctgcatggcgtcgtggagcaaaagtagaaacaggtccgatttgggatgatgttgggggcttgaaaggcattaactggaaaacgaccccagctccagacttctcctttataaatgaaactccaggtggaggggctcactcgacgtctcatacaggtcctggcactccagtaggagctactgtggttcctaatgtgaatgtcaacttgggaggcattaaggttgatctgggtggcatcaatttaggtggaattacaacgaatgtcactacagaagaaggtggtggaaccaacataacatctacgaaatccacatctactgatgataaagtctcaataacatctacaggatctcaaagtacgatcgaagaagacactatacaatttgacgatcctggtcagggagaggatgataacgcaattcccggcacaaacacacctcctcctccaggtcctccgccaaatctaagcagttctcgcttgctgactatttcgaatgcgtccttgaaccaagtcttacagaatgtccgacaacatctgaatacggcttatgattcgaatggtaattcagtctcagatctcaatcaggatttaggccaggtagtaaaaaacagtgaaaacggagtgaacttccctactgtgattcttcctaaaactactggcgatacagatccatccggtcaagcaaccggaggagtcactgaaggcggcggtcatatccgtaatattatccaaaggaatacacaatctacggggcaaagtgaaggagcaacacctacacctcaacctactatagcaaagatagtgacttccctgagaaaagcaaatgtaagttccagctctgtgctaccacaaccacaagtagctacgacgatcacccctcaagcgagaacggccagtacatctacaacgagcataggaaccgggacagaaagcacatctacaacaagtacgggaacgggaacaggaagtgtctccacacaaagtactggcgtagggacaccaactacgacgactcgatctacaggaacttcggcgacaaccacaacatcatcagcttcgacacaaacaccccaagcgcctcttccctctgggaccaggcatgttgctacaatctccttagtgcgtaatgctgcaggaaggtctattgtattacaacaagggggtcgatctcaaagcttcccgatccctccctcagggactggaacacagaatatgggggcacaattgtgggctgcagcaagtcaagttgcttccactttaggccaggtcgtgaatcaagcagctacagcaggttctcaaccctcctctcgtagatcttccccaacaagtccacgaagaaaatagctcttcgtaatctagttgagaaaggcaagtccgtagaagtgaatagctaaaatacgaggtcctgaaacttaggacatgttgtggtagacgtcatccacatcttcgatttgctctagccaatcaataagagctaagtttgcctcgccatctttctcatcacaatctactagacgcaagggaagataaatcaacctgtcttcactacaagtcgcaccctgactgataagtttctctttaacggaggcaagttcacttggagcacagatcactaagaagttttcttcatcttcggtatcgagatcctcagctcctgcttctatagcataagaaaatattacttcttcatctatagagctcttagcgacagtacacgcccctttccttgcaaaattataaagtacgcttccaggttctacaagagaacctccacgtttatttatagcaatgcgcatatcagaagccgtacggttcttgttatccgtcattgcttccacaataattcccactcccccatgaccatacagctcataggtaacctcttcaaagttcttttgctctgcagaagttgctttcttcaaattcctttcgatattctcattagggatattattttccttagctttctgtatcaccatacgtaatcgcgcattggacttagggtcagctccccctaatttaacagctgaaatcaactctttaataatacgagaaaaaatcttgccttttttatgatctgctctttccttgcgatgtttcgtattggcccacttactatgccctgccatatcctccacctactctttttttataccctcgcaataaataagcgtttgccttttcccaagcaacagcacgatcatacaaggggaaacgttgttcgtattctttaaactttttaccatgaaaaatcgaacgccccgatagagaatactctctagggactacactatgaaccatttcatgatacacaagatattccataaaaaatcttgggatttcctgccgatctaaagaacgatgaattcgaattaactgttcattttcatgaaacaatcccaagacaacactcttgccttttctggtagctttccttccgaaccaaccaatctgtaaacgcagtgcaccttgaaataactgcgcattcaattcctcatagatctcctgcaaatcatagatctttcccggacagtagtctactgggaatgaaggacgagcaagaaccctgtgcgaagataggaacgtctttttacgacatgggaagcgaaataccctatagagatacttgctcagataacgttggaaattatgaagtactgtttcaaccataacgataggatgtctaaaacctctttctgcgctctatagatccttttccatagtagttttagcaagatagccgatttcatctttataaaaacggttttgccttcctacttcgacaaatccaaaacgttggtagagatgcagagcaggattgccctcatagacttcaagatagaggacctcaagcttaaatcgcgtcttcgccaaatgaataagattgtttagcaaggcggtccctatgcctttattacgaaactcttctccaacaataatggaaatcagcgcatgatgggaaaccttaacataagggttaagaaccaaagttgccactccagcaacattcccattgtacacagctgttaagctagaatgataacgatagaatcctacccagaaatttacagtctcacgaatttctgcttccgtttggatgggaaatccacgtaaaattttaggatcattcagccattttagcatatacgttgcatcgctaggaagagtgtaccgtatttctaatcctagaattcctgtattttgcttttctgctgtcatgaaacttctccaaactctgccaaatatgctttaataaattcatccaatagctcgccgtcgagcatcgcttggacatttcctgtttcatgtcccgtacgtacatctttaacaagagtatagggctgaaatacgtagttgcgaatttgagatccccaagcaatttcctttttatctttgcgatcaagagattgcttctctaaacgttcttgtaaaacctgctgatacaactttgcttgtagcattttcatacagctctcacgattctgtatctgactacgttcattttgacatgaaacaacgactccagaaggtaggtgcgtgatcctgactgcggattccgtaacgttgacgtgttgtcctcctgctcccgaagaacgaaacgtatctatacgtaaatcattaggtcgtatctcaatcttaatctgatcatcaatctcagggaagacgtctacagaagcaaagctagtgtgacgtttcccattactatcgaaaggtgagatacgcaccaaacgatgtactcctcgctctgccttggcatacccataagcatacattcctgaaaactttacagtaacatgcttaattccaacaacttcaccatctaagcgatcgacaacctctaaggcccattgatgtttcgtcgcccatcgggaatacatacgaaacagcatctctacccaatcacacgactccgtcccacctgccccagcattgatcgtaaggaaacaagagttcttgtctgcctctccggaaagcaaccgttgcgtctcccaaacagcaagtttcttctcacaaaagagaaattctttctctaagtcttcacaaatcgcagggtcttcaagagcatcggcatcctcgaggaaaaactctatagcatctattttgctttttaattcctgatactcttggatttgtcgtctcagacttacaatctgttcagaaatttttccagcatgaacactgtcttgccaaaaattttcttcggaactttcttcttctaaaacttgaagttctttttgttttttatcgaggtcaaagagacctcgcagctaaagatatttccgtgcgaagtgcttccaaacgcttgtctaaattttcctgcattactcttaccaacctacgattccaatcaagattctagaaaacaaaagccaataaagtcaattagagcaaggacttcctagagcttctatgacttaaacaaaaaccaagactttttcttctttttggagagaaagttctttgttatatcttttctaaagactccccttgacgctttctaaatagaaaaggtaaagagaattccacttttttgttttgacgagaaacctctctgagagataaaaaagttgggatgaagagctcaggtctcttcttaccacctttactaggagtcaccaatgagtcaaaaaaataaaaactctgcttttatgcatcccgtgaatatttccacagatttagcagttatagttggcaagggacctatgcccagaaccgaaattgtaaagaaagtttgggaatacattaaaaaacacaactgtcaggatcaaaaaaataaacgtaatatccttcccgatgcgaatcttgccaaagtctttggctctagtgatcctatcgacatgttccaaatgaccaaagccctttccaaacatattgtaaaataaggaatttgttcgctgttgacttaggcttaagaaagcatgagctctcattctgatatgttaagtaccctgccctttagggcggggatataaagtgatctttaatttaaaatggagttttttctattaagaaaagaggaatacttcaaaagcttagtatcacctataataggaaaattcttgggccccataaatagtctcaagtttctcgtttttaaagaccggaaattagacaacaaatagttttatagtgcttatctctatttctttagccacccttcctattcttgccttttcttgggcttccttcattgaaccgaattggttaagaacaactgctattccatggaggcttccaaaaaaacatgcgcatttgcatggtcttcgcatcgctcagatttcggatctccatttccataagagagttcctgagaaatttcttaataaagtttccaaatcaataaaaaatttctctcccgatcttattgtattttgtggtgacctcctttgccgtgctcgacttgaagataaggaacgacttgaaaccttcctaaatacattagaagctcctctaggagtctttgctattctaggcaatcacgactattcttcgtatatttccagaaacactaaaggagagattacctgtatccctgaggaaaaaagtcgtcctatacaacgcgccatcattgctgtaatgcaagggctattctcctctcctagctatcgctatgatcccaatctgactccccaagagccccacccagacctcttaaaacttctgaagaatactcccctaactctccttcacaataccacgcatgtcattcctaacactcttaatattgtaggacttggggatctgttcgctagacaattccatcctgaacaggcattcaaaaactatgatccttctctcccaggccttctcctttctcataatcctgatggcataactaggctgcaacaataccctggagattttgtactttcaggacattcccacggtccacaagttactttgtcctggccgaagtttgctcgaaaattctttgaaaggctgtcaggattagaaaatccctatcttgcacgcgggtatttcgttactaaggaaggaaaacaactctacgtaaaccgcggtctcggcggactaaaaagaattcgcttctgctcccctcctgaaatctgctacatcacatgttcctatgattaagtcttctctaatacttcttagtggaggacaaggtacacgttttggatctaaaattcctaagcagtacctccctctaaatggaactcccttagttcttcactcattaaagatactctcttctttgccacaaattgctgaggtgattgttgtttgcgacccctcatatcaagaaacctttcaagaatatcctgtctcttttgccattcctggagagcgtcgccaagattctgtcttttcaggactacagcaagtctcctatccctgggtaatcatccacgatggagcacgtccttttatctatcccgacgaaattcatgatttattagaaacagcagaaaagatcggggcgacagctctagcgtctccgattccctataccataaaacaacgcaatcctgtgcgcactctggaccgagacaatttagcaataattcatacccctcagtgtataaaaacggaaatcctcagagagggtctagctcttgcaaaagaaaaacagctcacactggtagacgacatcgaagctgctgaaatcataggcaaaccctcgcaactcgttttcaataagcatcctcaaatcaaaatttcctaccccgaagatctaacgattgcccaagccctcctatgactaaagtagctcttcttattgcttatcaaggaactgcctattcaggctggcaacaacaaccgaatgacctatcgattcaggaggttattgaaagttccctaaagaaaattactaaaactcgcactccactaattgcctctgggagaaccgacgcaggcgtccatgcctacgggcaagtggcgcatttccgagctcctgatcaccctctatttgcaaacgcgaaccttacaaaaaaagccctcaatgcgattctccctaaagatattgtaatcagagatgttgctttgtttgatgataatttccatgcacgctatcttgccattgctaaagaatatcgttattccctatcaagacttgccaaacctcttccctggcagcgccatttctgttatacccctcgccaccctttttctacagagctcatgcaggaaggtgcgaacctgcttataggaactcatgactttgcctcttttgcaaatcatggcagggactataactctacagtacgaacgatctataccctggatattgtagataaaggagattctctctccataatatgcagaggaaatggcttcctttataagatggtacggaatcttgtaggagcccttttagatgtggggaaaggagcgtatccacctgaacatctcctagatatcttagaacagaaaaatcgtagagaaggaccttcggcggctcctgcctacggcctttctttacaccacgtatgctattcctctccctacaataacttctgttgtgagcaatgctctgttagcacgtcaaacgaaggataagagaaaaattctttgcctttaagttcagggtaatcttcaggggtgatctccgccatcgaattgatacatactaaagttgctggaatcttggagagcgcccgaagccccttcacagaatcttcaaatcctataactttcattccttcacgagcaaacgtccgatacgcgtagtcataactatctccgtaaggcttagggcgtgcataattttctcgggtgacccagaacaaaaatttatttaaaattggatacatagtacgtagtgtgtgcgtggcatctcttggagagttagttacaactccaaatgttttattcaaagacaagacaagctcgatgaaagcttcgactccaggcatcagagcaggacctgcgtgttctaaggacttgtagtaaatctgcagtcgttttgcaaagatctccgccatgtactcttgtgcttggggatattgttctataaactttttgctaaaaatttctgttcctaaggtagtatgactataataggtagaaaaatcccaatgcacttctaaagaaaattcagcacaggcttgtaaaaatgcacgataaaaacaaggttctgtatctacaagcaaaccatctaaatcaaaaaagaaaacgtcataatcctctaaatacataccactcctcaaacacaactgaaactcgtcgcttaccaacatactataaatccaacattgtcttaaaaatgattttacggatctccaccgtaagccttcttacaagttgctccttctcgaaaaattctcgtacctgtttcgtcactccagaacgcattacctcacaaaaagactgccccgtccttctccatccaaaaagcactacgatttctccccctctctatgactggatctccccaaatagagaggtaatcaccgcctattctttctactgccgaggtcaaggaaactctatcataactcccgaaggggttctctatgattgtgatggactccatcacagcataactaaagaagagttccgttatatccatcctagattgattgaggtagtacgactcttgcaacaagatcaccctaaagtctctattattgaagccttttgttgtcctaaacactttcattttttagaagcctcaggaatctcactctctcaactccatctccaaggtactgcagctaccttcgctctagatcctcccctccccatggagaaactcttggcaactataaagaaactgtataaaaaaaactccgatccttctctctctaattttatcgttacagaagctacactgaccaatccagaactgcgactcacgcaacaagatctcggctcgcatacagaaattactgtagaaattctcgataatctacaaaacaaagaggctctttcctccgcataagagatttctcttgcgataattagaacagaaaccgtacattcgtggctcactttatgccggtgtggcggaatggtagacgcggtagactcaaaatctactcttagcaataaggtgttggttcgagtccgatcaccggcataattctttcttttttcaggttgccaataaattgttttgtcgtttttcttagggaaaaccaaagtaacaccccgatttcttatgaatgaaagaaccctcttgctcttgttaaaaaagaagaagggccttttccttgctattttagatcttacgcaaacagaatcctctctaacgactccagaattagagaaagtcttaaagcaaaaaaaaatctttctttcttgcatcgatagagttgatcttcaaatcaaagagtttcgccatgccttctcttccgaacttccccaagatatccaagaagagctggaagaaatccgtgatgttattattcgtattctagatacggataaacgcaactatgcacagaaaaaaaaggaatttggtatttatgaacgtccctgattccaagaacctccatcctcctgcatacgaactcctagagatcaaggctcgcatcacacaatcttataaagaagcgagtgctatactgacagcgattcctgatggtatcctattactttctgaaacaggacactttcttatctgcaattcacaagcacgtgaaattctaggaattgatgaaaatctagaaattcttaatagatcctttaccgatgttctccccgatacgtgtcttggattttctattcaagaggctcttgaatctctaaaagtccctaaaactcttagactctctctctgtaaagaatctaaagaaaaagaagtggaactcttcatccgtaaaaacgagatcagtggatacctgtttatccaaatccgcgatcggtccgactataaacaactagaaaacgctatagaaagatataaaaatatcgcagaacttgggaaaatgacggctaccctagctcacgaaatccgcaatccgctaagtggaatcgttggatttgcctctatcctaaagaaagagatttcctctcctcgccaccaacgaatgctctcctcaatcatctccggcacaaggtctctaaataaccttgtctcttctatgttagaatatacaaaatcacaaccgttgaacctaaagattataaatttacaagacttcttctcttctcttatccctctgctctccgtctctttcccgaattgcaagtttgtaagagagggcgcacaacctctattcagatctatagatcctgatcggatgaacagtgtcgtttggaacctagtgaaaaatgctgtagaaacagggaactctccgatcactctgaccctgcatacatcgggagacatctcggtaacgaaccccggaacgattccttccgagatcatggacaagctcttcactccattcttcacaacaaagagagagggaaatggtttgggacttgctgaagctcaaaaaattataagactccatggaggagatatccaattaaaaacaagcgactccgccgttagcttcttcataatcatccccgaacttctagcggccctacccaaagaaagagccgctagctagaacgcgttcttgaatcttcaagaccacttagggttctcaaagatcatctacgatgttttcttatccttgaaattgctcttgctctagtctttcaacctccgctctaagctgtgcattttcttcttgcaatctttgaagctcgacctctagctcaaatctcattccagcatcttctcgaacaggagagagaaggctctcaaggtcacagcattttctctgagcagcttcgcaatctttgatcgcttgtgcatgcatcttatcaagagctcgtaatccttctttctgctcttctatgtgttctcgaagcttgctgatttctttttcagcttctacagcatcggcaaccagttgagtcaattcgttagatttaaatgcaagtgctttcaggagttcttgattctcttccacgagttcgcggatcttcttctggctgagagaagcagaatctgtgagtacccagtcatcgtcctcaccgatctcagtaggagcagcggcaccctctaaatccgctaacttcttcttgtaggccatgttttccttttgagccttctcaaagagatcggcaaaatgattcatactttcttctaagattttttcttttacctgtttctcctcttgaagacggctatacctttgttgtagctcttggaaatctttctcaactttttctgcctcacgcagactgtcctggtactcaagaatgaatgtactcagacgtctaatttcttgggtttgttcgtagtcttcctgttgctgcttccctaattcttcttcccaaacagctgctgctttcttcagattagcatctttttgttcgagctgcttctcatagtcatggaccagactctctaagcaagccttctcacttttctctgcgttgacttcctgtaaaatcttttgcatatctagtttctgactcagatatttctctttatattcgcgatagaacagagattgttcgtcaaaagcaatcccagtaagtctcagatcctcttgtaatctttctaatttggcattctgcttacgccaagccttctcttgttgatggattgtgcccctcatctcaatccactcctgcatagatttcagctgtctccttaaatccttctccagttgctggcgttctgcacaatccatctctgtgccctcacaggcacgctgcgaagcctcgcgatcatgagcccgttgtatatccttctgagattggttaatacgttgtaaagccgtccagcatctcttctgctcgtcatcgatccgactccttaaatcttgcaccgtctgctgctgcaaactgattagatcttgtagacgagaaatctctttttccccctcctctgatctaactgtcataattccttgaacaaatcgctcataacttctacggttaaattctagccgatcggcaaccagactacgcatttccaagagctccagcaagaactcatacctttcctcgtctttaagatgggccgtcgagcgatacagaatctcctcttcacgtcgcagcttacgatccaacattccaagacgcttttcacagtctacaaccacctggggcaccgcagggtccttagcgtctctatcctttaagagaacctctaaaagagtcccttcaagaacttctctggtctcgtttcttaaatcttcaatctgaatttgttgtggttcaggaaccggagggagttcctcaggaaggccctgagaatcataaagacataaaatcaaagccaaagcaaatataacggctcccaaagcaatcagacctgttccaataaacataggaactgctggcagcaatcctacgagtaatcctccccctaaaatagtaagaagagcaagaataataagacttaccttaacaattgtatgattccatccacactgctggactcgagctattgccatctcccctctttcctcaagcgttagcggggaaaagacagggtggttactgcctagctctcttacaaaactaggatcttgaaatgtaggggatttttgagcgggtgttgccatgttgctactacaatctccaattgaaaaattatttggcctaaggattttacgtcttaatgatatttaaatacaacgattaaatcgtatttcttattttataaaaagtatttgataatattttttaaattctttctattaaattgaaagttttgcttcatttttcaagatttagtaaaaagaaaaaatgaatccatccaggggagagaacatggcgattaaaaatatacttgttgttgatgacgagcccctactcagagatttcctctcggaacttcttacctcacagggattcatcccagacactgctgaaaacttaagaaatgctctccaaatgatccgaagtcgagactatgaccttgtcatctcagacatgagtatgcctgacggctctggtcttgatttaatcaaaattataaagcaaagctccccccacacgcccgtccttgtagtcactgcttacggaagcatagagaacgccgtagaggctatgcaccaaggggcattcaactacttaacaaaacctttttcttctgaagcactttttgcctttatctctaaagctgaagaacttaagaacctagtccatgagaatctctttctacattctcagacaacaccagattcacaccctctgattgcagaaagcaaggctatgaaagatcttcttgccatagcaaaaaaagcagcttcaagctcagcaaatatattcattcacggagaatcgggatgcggaaaggaagtcctctccttttttatccaccacaactctcctcgagccaaccacccctatattaaagttaactgcgcagcaattcctgaaactctcttagaatcagaactttttggccatgaaaagggagcatttacaggagcaactacaaagaaggcaggacgttttgaacttgcccataaaggaaccctcttattagatgaaatcaccgaagtcccagtaaaccttcaagcaaaactcctgagagctatccaagaaaaagaaatcgaacaccttggaggaaccaagaccctctccgtagatgttcgcatcttagcgacctcaaaccgaaagcttaaagaagctatcgatgataaaagcttccgacaagatctgtattaccggttgaatgtcatccctctacacctcccccctctaagagaccgacaggacgacatcctccctctggcgaactacttcctaaataagttctgccgcatgaacaatactcctctgaaaaccctctctcctaaagctcaagagctcctccttaactacccctggccaggcaatattcgagagctctccaatgttctggaacgtgtggttatcctagagaacacctccctactcaccgaagacatgctcgctttagcttgatctcctctaggggtttttcttgtttttctcaatagcatctggtaagctgatttgctttaatctctgtattcttttaagcaccgatagctcaattggatagagtacctggcttcggaccaggtggttggaggttcgagccctcttcggtgcgttaaattctttttttgaataggtatttctccttataatagagctatggagaactatttattttatctactctcctaaagcatcacgtaaccctaggagacaagatgagacctcatcgtaaacacgtatcatctaaaagcttagctttaaagcaatctgcatcaactcatgtagagatcacaacaaaagcctttcgtctctctatgcctctaaaacagctgatcctagagaaaagcgaccacctcccccctatggaaacaatccgtgtggtgctaacctctcataaagataagctaggcaccgaggtgcatgttgtagcttctcatggcaaagaaatccttcaaactaaggttcataacgcaaacccatacactgcagtgatcaatgcttttaagaaaatccgcaccatggcaaataagcactccaataaacgtaaagacaggacaaaacatgatctaggtcttgcagcaaaagaagaacgtatcgcaatacaggaagaacaagaagatcgccttagcaacgagtggcttcctgtcgaaggcctcgatgcctgggattctctaaaaactcttgggtatgttcccgcatcagcgaaaaagaagatctccaagaaaaagatgagcattcgtatgctatctcaagacgaggctatccgccagctagagtctgccgcagaaaacttcctgatcttcttgaacgagcaagagcataaaatccaatgcatttataaaaaacatgacggcaactatgtccttattgaaccttccctcaagccaggattctgcatctgaggactccacatcgcaatctcaaatcttcgatcccattagaaatcgggagttagtttctactcccgaagaaaaagtccgccaaaggttgctctccttcctaatgcataagctgaactaccctaagaaactcatcatcatagaaaaagaactcaaaactctttttcctctgcttatgcgtaaaggaaccctaatcccaaaacgccgcccagatattctcatcatcactccccccacatacacagacgcacagggaaacactcacaacctaggcgacccaaaacccctgctacttatcgaatgtaaggccttagccgtaaaccaaaatgcactcaaacaactccttagctataactactctatcggagccacctgcattgctatggcagggaaacactctcaagtgtcagctctcttcaatccaaaaacacaaactcttgatttttatcctggcctcccagagtattcccaactcctaaactactttatttctttaaacttatagctaatcatccatgcagatctgtgttaccggcgttgtacttcgcagccgccccttaggaaaaaatcatacactcaccactttatttacccctgaaggactctttaccttttttgcaaagcaaggacaaaccctccaatgtgattatcgagaaacccttgtccccatatctttggggaagtatacgttacatcgtaatggctcacgccttcctaaactgacccacggggatatcctcaatgccttcgaagcaatcaaacaaacctacgctctcctagaagctagtggaaaaatgattcaagctcttctggcttctcagtggaaagaaaagccttcgcataagctcttctctttattcttgaatttcctccaccgtattcctgaaagcagcaatccagaattttttgcagccatctttgtacttaaacttctccaatacgaaggaatcctagacctgactccagcatgttcgctatgcaaagcatctctaccctatgcctgctatcgctaccaaggccataaactatgtaagaaacatcagcataaacaagccatctccatcgagaaagaagaagaacaaatcttacaggctatcattcatgcgaagcagttttctgaacttctagctattgcagaattcccgattgctatagctgaaaaaattttttatttgtttgactcgctacaagaggaaaaaaaatcagaaagaaattcttcggaagatccatatcatgaaatcctaagactttctaaagtagtccatccctactgatgaaggacgtgtaggcccctagaaattataattatcaaaggtaccgctgcaccaaacctttgaaaaaaggtgtgttttcctagaattcaagaaaaattgagagaaataaactccctaagagaaggtaattgtaccgccctcactagatacgttaaatattaacgtcacctcagagaatccaactaaatcattgtggtatattttattccatacaccccaaccctgttttataaacgtactcccaggacaaacgtttccttttaaagaagtttttgtatttacaatgacgccaacatctttaggcagttttaaattgatagattctttctgattagaaatggtaatggtactacttctattccatttgccacggaaatccatatccatcttgcaagaactacaagaaaaatttagagcatagagaacaggatagactcccctacactttgcacggagatgaccgaaagaaccttgataatttaaagtctctaatttagggaactctccagtcagattgaattcgacccgtttttttctctgcgcctggatttccatattctccatatcagggtagcttttcgaaaaatcaaaacggtgggtgtaaaatgattcttcttcagaaagccaacaagggacagaaagcagctgattcccaaaggaacccgaagcaaacaaaacaatgaaaaaaaataaatatcgacaagcgaatcccaaattatgatctccatacaaaaatagtcaaaaataaataataaaggagggggacatcacgaagctattgcgaaagaggggactcgaacccctaaggaaagctccactaccacctcaagatagcgcgtataccaattccgccacttccgcaagaagaaactagcttaccgaggctgtaccctttacctcaagaaaaaaagtatttccctaccacgaaaaatcaggtacattgtcctaatagctagaaggagtaaagcctaattatgcgttgcactgcctactgtacagcatctgcttataacctccatgtccttttccacctacttaaaccccgctatcctaccatcttatctagagaatatgttctcgcaaacctagatagtacacaggcaagcaaccagttagcgatcttcttccctttcggagttgccgtattctggggttgggaagagtccgaagaaatcaaacttttacaaacaatcgttacagcatcaccagaaattcttccccaacccgagatcgattgctataactttcattacggagataaactccaaatccggagggaccgcctgacccttgccgacaccacattaaatacaaagctcgccattgcttttggtctggcgcaatcggtaaaactcacaaccttcgaaactacaatctataaaactatagaagattctaaacggcttccccaagatcttgctactaaaggaaaaatttccatgtctcggaaagccatcgcaaaaaagattggcaagctcttcctagataaggcttcagtaaaccttcattccgatatcttggatgaacctgattttttctgggatcatccagaaacacaggcgatttatcgtgacgttctcagttgtttagatattgaggcacgaatcaatgttcttatcgtttgactattcttggagatgtgttagaaattcttaacgaccaactcaatcaccaacactcttcatctctagagtggacaatcatatggctgattatgttagaattttctgtagctctactcaaagatgttttcaatgtcatttaaacgtttcttgcaacagatccctgtacgtatctgtctacttattatctatctctaccaatggcttatctcccctctcttaggctcgtgctgtagattttttccttcctgttcgcactatgcagaacaagccttaaaatctcacggcttcctgatgggctgctggctttctataaagagaatcggaaagtgtggcccctggcatcctggaggcattgacatggtccctaagactgctttgcaggaagttttagaaccttaccaggaaatagacggtggtgattcaagccatttttctgaatgatcttatccataggaatgccaaacctcttagctatcaaccataaagaatccccgtcctgtaccacatactcttcatcctgatcttcttgaacacgaggagcctctaccctctgagtcgacatgcaggccaactctctacgcggagaatgctgtaatcgagagaagaaattctgactatagggagactcttgaggcatcaggcggatgaccttctcaagatcttcatcacaaaattcatgcaaaacaacatcactatcatggacaagcaaaagcaaggctgccagagattcttcacaatctaaataagattttaagactttctgacgttgtgtagctgaaatcatggaagtgcggctctcttcattgcaaaaatgaaagaaacgttcggatccgcaacgaatcaccatacgagctaatgaggctactgaagaggcctgcacgtctgcacctacaagtaacgtacgcaagtaaagaaattctggagtcgagcagaaatgatacaggcaatcttcatctacccagccttcttgtaccatcttttctatcagcaaaaacaagcccttagaagtatagggatacttgtggcaacgcaaatagtccaaaatcacaggaaagtctttaagatcaatattcggcaaaagccaccgcactgaagatcctttcaactctgtataggtcaaaggcttcgaaagcacaggagtgatgtctatgtggtgggaagctatcgctacactcaacgcccaaagttttatcggccgaccatacatatagcgctcatctttgaacaacgaaatcaagtcgtccaaagatgcttgagatatctcgtttaaaaaatcttcagaaaggtagaccttacgactacttttcgcaatcaaaggtccggaaaataaatgcagcttatagatgtctttacgaaatatggcagagtaaaataagagcaaaaaaagcatattcaatcccacactcaggatcaagacttgccacagccatctagtttttcttttgaaagccatacattttgcgcctaaaactcagttcattctctaggattaaaacacttgccactatacacaggtcatcgtaaaatccctcgtaaaaacatccttgcgtttatcatccatgcggattccaataactctactgcaaacatacttttcagaacctctttcgacaaaggaaattttagaagcctgtgatcatattggcatagaagccgagattgaaaatactaccctatactctttcgcttctgtgattacagcaaaaattttacatacgattccccatcctaatgcggataaactccgggtagctaccctgaccgacggggaaaaagagcaccaagtggtttgcggagcccccaactgcgaagcaggattgattgtagctcttgctctacctggagccaaattatttgatagcgaaggacaagcctacacaatcaaaaaatctaaacttcgtggtgtagaatctcaagggatgtgctgcggagccgacgagttgggccttgatgaactccaaattcaggagagagctcttttagagctcccagaagccacccctttaggtgaagatctcgcaacagttttagggaatacttctttagagatctctctaacaccgaatttaggccactgcgcctccttcctaggattggcccgagaaatctgccacgtcactcaggcaaacctcgtcatccctaaggaattctcgttcgaaaatctcccgactacagccctagacatgggcaatgatcctgacatttgccccttcttttcttatgtcgtcattacgggaatctctgcgcaaccttcaccaatcaagcttcaggaatctctacaagccctcaaacaaaagcccataaatgctattgtcgatattacaaattacatcatgctttctctagggcaacctctgcacgcttacgatgcgagtcacgtcgctttagactctctgcgagtagaaaagctctccaccccagaatctctcaccctattgaacggagaaaccgtcctcttgccctcaggagtgcctgtagtccgcgatgatcatagtctcttgggtcttggaggtgttatgggagcgaaagcaccctcatttcaagaaaccacaaccactacagtcatcaaagctgcctatttcctccccgaagctctccgtgcctctcaaaaacttctcccgattccatcggaatctgcctatagattcacccgggggatcgatccacaaaatgttgtaccagcactacaagctgcaattcactatattttagagatcttccccgaagctacaatctcccccatctatagttctggagaaatttgtcgtgaattaaaagaggtcgctctacgccctaaaaccctacagagaattctagggaaatctttctcaatagagatcctctctcaaaagttacagagcttagggttctctacgactccacaagaaacttccttacttgtaaaagtcccttcctaccgccatgacatcaatgaagaaatagatctagtagaagagatctgtaggacagaatcttggaatatagaaactcaaaatccagtatcctgctacactccaatctacaaactaaaacgtgaaactgctgggttcctagcaaacgcaggacttcaagaattcttcactcctgacctgctagatcccgaaacagtggctctaacaagaaaagaaaaagaagaaatctctcttcagggctccaaacataccactgtattgagatcctcactgcttccaggattattaaaaagtgctgcgacaaacctaaatcgccaggcaccctctgttcaagcttttgagatcggcactgtctatgcaaaacatggagagcagtatcaagaaactcaaactctggcgatcctgctcactgaagatggcgaatccaggtcctggctccccaaaccctctctttctttttattctttaaaggggtgggtagagaggctgctctatcaccaccatctttctatagatgctttgaccttagagtccagcgcgctctgcgaatttcacccctaccaacagggagtgttgcgcatccacaaacagagttttgctactttaggtcaggtacatcctgagttagcaaaaaaagcacagataaaacaccctgtgttctttgcagaactcaacttagaccttctatgcaagatgctaaaaaaaacaacgaagctttataaaccttacgccatatatccttcatcttttcgtgatctcaccttgacagtacctgaagacatccctgcaaatttactgagacaaaaacttttacacgaaggttctaaatggcttgaaagtgtaaccattatcagtatatatcaagataaaagcttggaaacacgaaataaaaatgtttctctacgcctcgtattccaagattatgagcgaacattatctaaccaagacattgaagaagaatactgtcgtttggtagctttacttaacgaattgctaacagacactaaagggactatcaattcatgaaacaattacttttctgtgtttgcgtatttgctatgtcatgttctgcttacgcatccccacgacgacaagatccttctgttatgaaggaaacattccgaaataattatggcattattgtttccggtcaagaatgggtaaagcgtggttctgacggcaccatcaccaaagtactcaaaaatggagctaccctgcatgaagtttattctggaggcctccttcatggggaaattaccttaacgtttccccataccacagcattggacgttgttcaaatctatgatcaaggtagactcgtttctcgcaaaaccttttttgtgaacggtcttccatctcaagaagagctgttcaatgaagatggcacgtttgtcctcacacgatggccggacaacaacgacagtgataccatcacaaagccttacttcatagaaacgacatatcaagggcatgtcatagaaggaagttatacttcctttaatgggaaatactcctcatccatccacaatggagagggagttcgttctgtgttctcctccaataacatccttctttctgaagagaccttcaatgaaggtgtcatggtgaaatataccacattctatccgaatcgcgatcccgaatcgattactcattatcaaaatggacagcctcacggcttacggctaacatatctacaaggtggcatccccaatacgatagaggagtggcgttatggctttcaagacggaacgaccatcgtatttaaaaatggttgtaagacatctgagatcgcttatgttaagggagtgaaagaaggtttagaactgcgctacaatgaacaggaaattgtagctgaagaagtttcttggcgtaatgattttctgcatggagaacgtaagatctatgctggaggaatccaaaagcatgaatggtattaccgcgggagatctgtatctaaagccaaattcgagcggctaaatgctgcaggatagtttgcggtaatggctgatgacaccctcattcctaaacttatgaagaactcgctttcgcaggcgtgttctgagggtttactgattgctaagtatcctccactccaggttatcgttcactttgataataacctagttgttaaaacacatctttcagtagctcctgtcttctcttgtctttttttaggaccagcagctcacaaagccatgcaggaaattgttttatggtgttctcgctatgccaacaaggaacatcctcctttttcctcgcattttgctaaagacctcatcccctcacaatatctcgaaatcctaaactgcgttgcagagattccctttggagagcagcaaacctacgctgaaatcgcaaaaaaaactgatacgcaccccaggactgtaggagccgcatgcaaacaaaatccgtttctgctgttctttccctgtcatcgcgtcgtaggaagccatggagagcgtaattacgtcctagggcctgtaattcacgagatcttattgaaatttgagaatagctactaatccccagctatagatttaagagtcttgcagacggggatctaaagcatcacggactccgtctcctatcagagcgatcgcaatcagcaacatcgttaatataattgctggaggccaaagaacagcactctctgcagggaatcctgtaacaccctccctcataagatttccccaagacgcggaactctcttcccccagacctaaaaaggtcagccctgcctcacagctaatcatagccatcatagcaaacggaactaaagagatcacagggacaatggcattgggaaggatctgatgcaccataatataatagtggctataccctaagtttgtagcagcaagaacataacctcggtctcgctgtttcaacacctcaatacggacatacctactaaaccctgtccaactaaaacagcctagcaaaactgtgttcaatagcaaagatttctgctgtgttatggaaatcaccagcattaagataaacagcacaggcatggtctcccaaatttcagtaaaccgagataaaatcatatccacggtcccaccgaaatatccagaaaccaacccgatcataatcccgatagctaaagctatcgtaatcccaatacctgcgactaccaaagctatgcgaatgccaaatactaaagccgctagtaaatctttccgagtgactctgctaagctgccaccaaggaacatacttgttcatttctcgagatcccccagcatcatcttcccaatggaaactactgaaaaaggggttaatcaaaatgcgaagatcttcagactctttctcgatccacaaacgcttatcttgaatgaaactgatcgcgctgcgcagcttggcatagtcttcaagtacctgacgaatctccaacaaagattttttatagggctctgctcgtttctctacattagcataagcaatacaaaggtcttcaggttgcccccagttgttgtaatccgcgaggcggagctcatgctctattcttgtcaaggccatcagaaacggtcggtagttgtccgtagcacgattccaagcttgctgcgccatctcatagggacgctgcatcttgtcgactctttgctgtaatcttttaaggcaaatgccttcatttttcatctctaagtgacgcaatgttggcatcggagactgccgtttttcttcaaaagcgacctgatacttctttacagaagcctcttgtttctttcgatactttgccttaatgagaatccccaactgctcatacgtactcatataccgccgttccatctcccaagtacgtgtatctttggggagcagcatgaccatctcagaattcaccttactgatgttttctcggaccttctcagctcgcattttttttaaattctcagctaacgcgggatcttgaactttcccactataggcccaagcaaaaatcatacattgagaaatgatgcacagccccaacaaccaacgacgtaaccaccccctagtcaacttaaaagaaagtatgaaaaagggaaacgtgaccatcaaaacgttgaaaaagagatccactggtttagtgtaatacccagggaaaaacaagtacctcagtaaaggaaaaaagatctctccatgccaggtgactagtaaaggtttactactcgcaaataaaggagcgtagatgccaatcagagcgacagaaataaaaaatttccatgataaagaggctaataaatttttatagtaagcagatagaaaacgttgataaaaggaaggatgcttctgcatttatatcctccttccctctagctgaactcgaggatctaagagtacgtagcaaatatctccgagcaaatatcccactaaagatagagccgatcctacaagcacagaaaatagaactacattgtgatctcgatttaaaattgcctgatagaagaagttcccaaagccatctatattgaatagggtttctacaaccaacgcccctccaagtaacgttcctaatgaagaggctagagaggtcactatagagactgcagcatttttccctacgtgcttatatagaatatcaaaccaacgcaatcctcgagctttagcagcacaaataaaatcttggcttaatacttctaaaaatatcgaacgacttaatcgtgactgtgcggcaagagctccgtaactcactgcacagaaaggtaaaaacccatgcgacaccaagtcaaagatacgtcctagagtactgagctcattaaaaacctctgggggcgaacgtaacccagagtaaggcataggaattgtggtaaatggaatcgttttattaataacaaagttatctaagatccagggaaccgcaacaaagacaggaatagaaaatagaataaggaaaatgaaatttagagagtgatctatccagcggtttcttttcaatgccatgatcataccaaagatttggcataacacaaagcctacaatcataggtaaaattgacaagaccaaagaacaacgtaaacgcttgatcacttctgaaattacagtcttatgtgcgtcatttcgtaaagttccaaaatctaaccgcaacacccgggacatatagcgagcaaagcgagtctctaagaaaaaagtcttccagaactgcttagagctatagcaaaaaacttctgttcccccatgatcttggaaccacccttttaaagcttccaccttagtatcgagatcttcttcgttaagctgtcttactaaaaaagcattactttctgcgatctctttattttgagctctttgttctgggctaagattagggccgacaaatccttggaggacgccaccacgaataaacaagtctgcagcaatatggcgatatttatcatctcgcgaagcatcgtcagcttcaaataacaatgcgggcataacaaacttcgcacaatccccccaatagactaaggacttagcagcatttttcgcacttggagtagtattatttgcatttgcaagttcttggagtgcagtctgaatcttcttatgagtgatcttagggcgagtgttaaaaaaaatggggagcgtgaggccataatgctctcgaaactgcaaataacggtccgggcccttgtaagagcgcatcttatcggattttccagcttctcccaaagcgtccctagacttttcttccaagacatctccaggagccgcatttaaaattacaaaatttatagagacaatagcaaataaagtcagggggattaaaactagacgttttaggatgtacttaagcacggatcctccttcttctcaagccataccatagttacgttgacagtctcatcctgagcttcaggaattaaatctgttctatgtgtaggtacgaaaatattttttacataatccttataaagtaaggaacaatgtcgtgagaacaagaaagcataaggagcttcctcatgaataatttcatggaaacggtggtacaggcgattacgttctttcagatcgtattcgtagctgagtctgtctatgattttatcagcttcttcattatggaaacctacaacattcgctgaacccttttccatagccccttcagaatgccataaagccctaggatcctcaggaggaattcctaaacaccatcccattaaaagagcatcgaaattcttttcatcaaaagcttgcgaaagatcggccatatctagtcctagaaggctacactcgattccgatttccttacaagcagtagctacgtaatctgcaatggtatgagcggtgacactctttacataatagcataaacggaaacggaacgggacaatcacaccatcgataactttttctcggattccatcgccatcggtatctatccatccctcttcttccaggagacgagctgcttcttctggagaataatgccacccttcgatctgtttattataagaaggagaactcgaagcaaaaggcccactaatcgtatagccttggccatccaagcactgttcgataatcctctctctatcgattgccatgttcatagcacagcgcacctgtcggctttggaaaaataatgaaaagcaattccatcctatgtacgtatatgctcgatctgctgagactgtttcacggacggctcctcccttagctacctgtttgttataagcggagcttttcataaaactatagaaattatctctttggttgggtggaaggtaagagatgtctattttccctgtcttaaaatcttggaatagggagtctgtgctttccttaaaatagacgaaacgcttgtcaataagagccgcaagaggatcatagaagtcaggatttctagaaaacacgattttctcatcatccatccctgcaaagtagtaggctccacaacttacaatatagttgtttgcccaatgcatagtgaagttttgcgcccaaatggaattggttcggtaggtatcgatattctcatcttcaatgattttttccccgttagcaaaatactgatatacaaatctagggaggggctgcaagcttaaggtattagaaaatgcagagtagagcactttgcgctcttcctttccttcttcattgattaccgtgtgtgctttccatctgactactaattttaaatcgttttctactgagacagaaaccacatcttcataacaagagcgcagagccactgctcgcatggttgctacataagggttcataacagcgtcgtagaaaaacttaatatcatgagctgtcacaggatgaggacgttgaaatacttcgtctaactgaacgtgttttggaagggccttaggatctataggacgccaaaaaacattcggcctcagatagatgtgaaactctttatccccagaaccatcttcaacaagatgttcttctattttcacagcgagatctggagaaaattcttcgtatttccctacgtggggagaagctaaactaggaatacagagatcgtaaaagcccacgacataatcaaagccattaaaagggctcagattttcgggttttccgacatgggcagtgcgtaggataccatgagggtggaaatttgttcctagaagttcaggaagagtctgctgtttataggggtctagggaaagtaaattaggataactaggatctccaaagagtagagcaaaagcttcgtctctgacgagcttaggagcgagcatcaccccaggtgccgcagggatagcttgtgatgtctgctgttgtttcactacgcgtgagatttcacgaatgtcttcttgaatatctcttacgttaccttttatcgacttaatgtctctttcaagtaggtctgaggaccagtataacaaaattaaagaaccggcgacaatcccctttaaaattttatctagcacacatcttttatacatgtgaccactctccctccgcttttagaggcaaggactcatagggatctctccccaaccatttaatccgagggaccttagatgctgcatagtattaaaatctctcaaaatcttatacaataagtgctgcttcgcacgattaagagaacatgtttcttccttcaacaaagaggaaaaggtcttttgttgatatttagatagcaatatgatgagctccccgtatgccaatctgtcttgtttgagttgtaaattcactggctgcaaacatggatcaaagtggtttggcagcatgttctgaaatctctttgcttggcataaactgtattgaaaagattttttaatcttcatgtaaccatgttatgctttggactatgaatgggtcaagaaatttcagaagagagggataaggagcaaagactcttttagaaattatttgtcgctacatagaacaaaaacaatctccaaaattttaatataagagagttgtgagtatggaaataacttgtcaactcatgggggaaaaagacaaatagagggctttcaccctcttgtttgtcttttaaaaactaaaaactattcagcagtattctcttcagaaccgccttcttcatctttttcagtttgagtgtcgctatctgaagattcgtctcgtccttcatcttcagaaccttgagcttcgtcttgtggtgctgaacaagattcgtatccaaaagcagaacctgcaacaggaagcacaagagctaaaagaagggctaacattaattttttcatttttattctccttatttaaaatacgacagctcaaacctgagattggccaaataatcagtaacctatgacaaaataaaggctgacgtaaaggtttccaggcactatataaaaaaagaaaaataatctgcaaataaaaagtataaaaacaaatggatagtgttattactcgcgttgttgaggaaacaagtaaataccatagagtaaaactataattcctatgattagtagacctataaccaatgggataggtaaaagccctaaagccaaacagccatctataaatacctgagcaagagggttcgcagtaaatataatacttaccgcagcagaagcacaaaaggcaactaataagcctagaattgctatagcactagcaatttcgtaacgagaacttacagacaaatccgcacgccaagaaaccctgactctattccacagactgtcttgccttaaaagaggataattaggtgttatttcgtccattgaattaatgatatcgtcggcatgtattctaggaaattgctaaaaaattagtatttatattcaacaccataaaatttaataagtttttgagattttttataatctcttttttttatctcttcgtaaattcttagacctttagcattcataccttgctgaaaataaagtattcctaactttgacatcgtttctacatcattaggttttaattttaggacaatttcatactcttggatttcttccataggcatttgcaagtcatgatagctataagcgagttgtgcgtgtacccaagcgttacctggagcatactcatttaaaatttggaactcttcaatagctcttcgcgccgttgcaaaaaacttttcttgaatctcagcgctatatctacccgaagggatccaataattagcatcaaactctgggtatttccttggatctgcgtaaagaccagaaagagctacatacgcatctgctaaagagacatgcgcactaagatctacagggatggcttgaaccactttgatataagcttcgatcgctttttggagtaaacattcacgaaaaagaaagtaatctttccaaaaacaaaaacaactaaatttcctaatgagatcatgcttgggcaagaatttgaatatctcagaaagaagagagtattcttgattctgaagatttatagataatttagtagctgctgccgctaaatgcgattgctcttctacaatgttctgggagcgtttattgggaggaacagcaccttgaagatactctgaagcgagatcctcaaaaaaatcacctttccccgaaagaagatagagccgtgtgacaaggcaaacaaacaatgtaagaaaaaaacacgcaagacagaatgctggaatgactgttttccctgagaatagaaagaaatatagaaaaaaactgaactcaagagcgatgagaagagaggctccacaaacaaagaggatctgcttaattaaatacttaagtaactgacgacttgttttattacataaagcttctaaattctcctgaaaacctaaaggtttcataaatcctgagtcctactttgttaattctaatggaaaattatgagattaattgttttaatgcaatgtttggtctccctatttttagcaaagaaagtcaccgtgacaactccagcctatctactagctaattttggaggacctcgtcatgctaaagaccttcaagaatttctgatttctctacttactgatagagatgttacgggcactttccttcccagagtactgcataggcatctctttactttcatcgctaaaaaacgtgttccgaaagttctccctcaatatcaatctttgcaaaattggtctcctatttattttgacaccgaaactcttgcaaaaacactctctgaaatcttacgagcgcctgtaattccatttcaccgctatctacccagcacacatgaaaagacgttgcttgctttgcgtactctacatacgcgtcacgtgataggtatccctttattccctcacttcacctattctgttacgggaagcattgtacgtttctttatgaagcacgtgccagaaatccccatttcttggattccccaatttgggagtgattctaaatttgtctctctcattacctgccacattcgggatttccttcagaagttaggaatcttagaaaaagagtgctgcttcttattttctgtacatggacttcctgtacgctatatctctcaaggagatccctatagcaagcaatgttatgaatcattttcagcaattacgacaaacttcaagcaatctgagaattttctttgcttccaatcgaagtttggtcctggaaaatggctctccccgtccactgcgcaactatgtcaaaacatagatacggataagcctaatgtcattgttgtgccttttggcttcatttctgatcacttggaaactttatatgaaatagaaagggactacctgcctctgctacgttctcgaggatatcgggcattacgaatcccagcgatttatagctcccctctttgggtatcgactttggtagatatcgtgaaagaaaactctacagtagttgccgaggagttaataaagagcgggaaaaaacacacagggattcgataagattttagggaagacgataccgctgttttatagcatcgtattttcctgagcgtcgtgttttcacaagtcctgcgttaaacccttcaagcaaatctccgtttgtccctttcagtattgcaagccgcaaaccatctgcgtttaagggttttgaaataattttcagtcttcctttatatgctgtttctattagcgcggtcacttcaattacaggagctagaagagcgtcgtaacaattcgatgttaaggcttccaatgctattggaacatgttggtagaggctaatcacagcgtcagggatattttgagctacaagaactgaagagtcaaacttatacactccaataagacgacctttaagatcctctatagattggtaaggagagtcttgagcgacgacaaggacaggacctgtgagtaaaatgggatcagaaaattgatagtgttcgagcatctcaagagtaggcaatacagatgtaaatgctccttgggtctttttatcatctaaattctcaaagagatgcacccaatcttgatttacaatattaatatttagattctctttatagttaatctcagaaacaagatcgtttaaaaatgcgttggtatcggatgtataaatgccgaattgttttggaaaccaggtggcatcacgacctacgagaacttctctttttactcgagagcacccgaaaaagatcagtcccacagccagtaaacatattaaaaaatttaccttccaagaaaattttatcttcacgtttagctgtgcctcgctgttctgcctctttttgcatcatattctagataagaaatttttatccagcgcgctataaagcctaattttaaagaagagggattcgtataaatatctgaaaaaatagaaacatataaaaaaattatcacattgaaaatcagtactttctgatattaagaaggactattcgatatttcctcagtcttaagggtccttttccacaatatactcagcaagatatgttttcccaagttttcttcttcgccttagggtcaaaccttcacaagcaatctcttcatcggaggcattctctaggaatagagtcccttcaggattcaggatgtttcccgaaacaatcttctgtaaaagggtttctacgtaacaattacaaagttcgtaaggaggatctatatagattagatcaaaggatctcttttgtttgataagtctttgaattgccgattgagcatcttgtctaaagatgacgacaggaagttgttctccgagtaaagcactatttgtgtgtattaattgtattgcttttatagagatgtccacgaatacgacagaagcagctccacgacttagggcttcaaaacctatcgctcccatcccggcaaaaagatctaaaaaagcagccccttctatatcttccctacagatactgaaaaacgcttctttcactaaacctgaagtaggtcggatatgtggattagaaaatgtttttaaggatttccctttgtacttacctgctaaaattctcacatcacctcttgaggaacaaagtttacgtaatcagcagccactagtatgtagtggatccctcggatattaccgaatccatctatagggcgttgcactttatgaatatgaccaaataggcatagagagactcttccatcagcttctaagaattccgaaataggtcctggagtaccgtcactgctgattggggggtagtgtgtcatcacaatcacctcagtgacttctttaggaagggcagcaaaagctctctttaaacggcccaactctcggagaaaaatcttttcatcctgttctgtataagattgttcctgagtagaaggagtaaggaaattctccttcttcacacatattgtaggactatcccacagtcgcactcctacaacagcaagatggggtgttaacagagcaaacccttgattcaaatagtatagagagggaggaagtgcttgtagaattttacttgttgaagcagaactccagtaatcatgatttccacgaatcatatacttcgttcctgggagatccccaataaaggcgaaatctttatgagcctctgagaggttcatagcccaagaaatatctcctgggaggagaacaatatcctctggatggacaacagcttgccattcagagcaaattttctgatggtatcctatccaggggtctccaaaaacttccatagttttttcagggacgcctaaggctagatgcaaatctgccaaaccataaatatgcatttgaagggagccagtgtaaaaacgcaattgccgtctactgtaggaactctaaccataaaaagcaaatgtctctgaagttcctatctctagagcgtcacgactgaccttgggagctacactttgccctagaagatatagttgtcaggaatgtgcgtgccttgaggaacaatgataatattatctctcacaaatagctttttatcaggagaatcatatttaatatagcccttgagattctgtagtttgacaccgtttccaatacaacaattctcatctataatcgctttacgaatctcacagtctttcccaattcctaaagatggcatggatggagatccgtaccgagcattgcccataattatagactgatcgactacagagttctctccaatcttactacgaatccctaagacactccgagatacatgactcgtattaataacacaaccctcacataataaagaacttgagatcatagaatccgtaatgattgctccaggaagatgatgatttttactatagatcattccgttatcatcataacaattcagtcctcttttctctgcatgaggcttttgagttaacgctatatttgcttcataataagattctatagttccgatgtcggcccaatacccattataaaggagagtttgtacttgtccccgcttcatctgagcttggatgagatgctttccaaaatcgtttccttcttcttcgcgaagcaaagaaaacaaactgtctcttcggaataagtagatgcccattgatccaagaaagtctcctgaatcttcggttaacttatgaatacggcgatcttcagaagaaagctgaaaacgcttgagtacttctttttcttgaggtttttcatagaaatcgatgagttttccttcagaatcaatatctaagactcccattctataggcatctttttctgggataggctgggcaacaagaaccatatctacatgagttcgtatggctgtatctacaatagatctaaaatccatattgtagagctggtctcctgataagattaaaaagtattcgatttctgtatcttcgaaataaagtaagttttttcgaattgcatctgcggtaccctgataccagatttggtcaccctgacgtgcttcaggagcaagaagatgtatctgatcctgcaaaactccatgataaaaatacgtcttaaataaatgctgttgtagagtgtaggtaaggtactgacctataacaaaaatttttgaaaaacctgcactaattgcatgagatattggaatatcgatcagcttataccgtcctccaaaagatacggtaggcttacagcgacaattagttagaggagataaccttttgccctcccctccacacaagataattactccaaccttatctcgataaaaatgagagctctcaaaatttgaggcctccggaaaatcgttttctatcatttgtattcgcctgttctaatttaattttaaattagaaacaaataaaaaggccaacacaacaaaacaaataaattttgttaaataattaaattctttttaataaatatgttctagaaattaagattcaatttctagaatttcggaaattttgtttgccagggttagatcaccactgcttagcttcccataagcgatcaaagcttttatcagagtgggtacagtaaataccgaactgacttttattccctgtggaccaagtggttgacacgcttcttttctacgatctaagaataccaatgcttcacgaactaccagaccattttcttccagtgcgactgctgtctctattatagattttcctgaggaaaccatatcattgatgactaaacaagtttgtcctggagtaaataacccttctactttaatagcgtccgaggggtctacattctgtaattccttccttcgcaataccatagggatgttatattttaaagagatcgaggttgctagggttagagcagtataagggactccgcagagtaagctactattgaatgaggggcggaggcgccaaataagagttgccactgtctggagaacttctggagaggagatcacaagacgcatatctacatacagaggagtttcttctccgctagcgagaatatgttttccgaactttatagctccgatttggtatagaattgctacagcttgaccgcgtaattttgcatcttcgtagttcatcattctccagagcctccgaccgtttttgacaaaatacaaaaaactcacttataagggaaaacatgctaatacgcctgtttcttggaatttctcttcccaaaggctttcccttatatttggagcctcctctagttcttgcaacgtttcaaggaactcaattcgtgggaacttatagtgaggctacaaaccctttgtatatcgataatttgaatctaaattaccactatactcaagaactactttataaagcagtcccgtgtaattataaatctatatatagagagatacctttaattattttcccagaagtactcataggaagcacgccaacacaatctactgagtgacgtcctacctaaaagcataacaaagattaagcaagactattctttgagtgacaacaagaattctgcgttactattggttttcttcaaccttcctagcaagagatgcatggcgtctatagtagtaagatctgctatggcctgacggaaaaggtagaccctttctaattcactaggatgatagaggagttcttcttttctagttccactcttaattaaatcaatagcggggtaggttcttcgatctgacagacgtcgatccaagacgagttccatatttccagtgcctttgaattcttcaaaaatcacttcgtccattctggaaccagtatcaattaaagcggttgcaagaattgtgagcgatcccccgccttcaatatttcttgcagcaccgaagaaacgcttaggtttgtgcaatgcactagcatcgacacccccggtaagaatttttccagaatgcggctgaactgtattataggcacgtgctaatcgtgttatggaatcgagtagaatgaccacatcatttccatgttccactaaacgacgagctttctctataaccatctcagcgacctgaatatgcctttctggttgttcgtcaaatgtcgaggcaacaacttctccacgaacttgccgaatcatatcggtaacttcttcgggtctttcgtcaattaacaagacaataagaacaatatcaggattattcacagcaatcgcgtgtgctatgctttggagaatgacagttttcccagatcttggtggggctacaatcaatccccgctgtccttttccaatgggggcggtaagatctaagactctctcagccaaatgatctttccccatttccatcacgattctttgattagggtagaggggggtcaggttttcaaaaagtacacgttctttagctttatctggagtagatccgttgatcttatctactttcaatagagcaaagtacttttctttctctttaggtgagcgtatcgtaccgataatcgtatcaccttttttgagatcaaatctacgaatctgagctggagaaacataaatatcttcagcagaaggtaggtaattataggttggggatctcagaaatccaaatccgtctggaaggacttctaacacgccttcacctatcagcaattcatctgggcgctctgacttggctttaacaatctcaaagacgacctgagactttgttagagatcctatatttttcacaccgtattggcgagctaatatattcagctcttcaattcccattctttgcagtttagcaatttttgtaactgtgacagactcggcctcttcagactcactggcaactacagcacactcccctacacaagatttttcctgcatagaaacgtaagcatgttttttcgtttccttcaccctaggcaagatttctgaagaacgctcttctttcataatgctccctttaaagcgtaaaaatattcttcaattttttgatgtaattcttttttagttccgttgttttcaacaacaacatctgcttgtgctaacttttcttcgacatttagaaaacgcgaacacctttgatcaaagtcttcagaggaacgccctgttttcttcatgaatctctcgcgtcgaatatcttcgtttgccataacaaggatcactgaatcaaaccacttagcatagtgtatttcgtataataaaggcacttctgcgacaaataacggatagttcccatcttgaatactttgatgatattgttcctcaataattcgacaaacttctggatgtagaatggcttccagaccttgtaatagaacggaattgtaaaaaactttggctgctatggcttgcgcatcaaacgccccatcaactacaacatccgatcctaaaagatctataacacgacgacctatgcgtgtatgagggataaggaaactatgcgaaatttcatcagcactaactacataggctcccaattcctgaaaaacttggcaagcttcagtcttcccagaagagagatcccctgtaatggaaacttttaataattttaacattctgcccaattttttccaattaagatattcacaactataggaacggataaagtcatagctgattccatcttctctctcactagtctttgcatctcttctatttcttcttcaggaacctcaaataataattcgtcatgtatttgtaataacatacgactcttcatttgctgttgctttattgcttgtgaaatatctagcattgcaagttttatcaattcagcagcacttccctgaatgcgagtatttacagcaaaacgtcctgaagctgctcttgagccaggaaattcattccaactatcgataattctttctcgacctaacatcgtggtcacccgtaaatctttagctgcttgttgtatagtttcttcaacaaaatgagcaatttcgggataacgagagaaatatgcttgaattaactcttgagcttcgccaatagaaatttttaaaacttttgccaaaccaaaagcctgttgtccatacacgataccaaaatttactgtctttgcctgcattctttgttcttttgaaacctgttctaaaggcacatgaaacacttgtgatgcagtaaaagcatgaatatcttctcctgactcaaaagcaaattttaatgacttatcttggcttaaatgtgctaaaaatcttaactcaatttgagaataatcggcagataaaaaataactatttttctcagataaacgaaaagccttcctaagtaagattcctcgttccgatcttataggaatattttgtaaattaggatctcgacaagctaatcttcctgtcacagctcctgtctgatcaaaagaggggtgtattctctgtgtatgggaatctacttgtttcggtaatgcttttacatatgtggataataatttttcaatcgtccggaaagctaaaagtttttcgataattgggtgctcactacgtaaagcctctaacacctctgcacgtgtagattttgccttatctatagggcgaagacctaattcgttatataaaatatctgataactgttttggtgattttatattgaatggccttccagaaagatcatagatttcctctgtcagtacggctaattctgtttcaaagagggcttctaaaatagccaactcctcaacatctaaaggcactccagctctttccatagagaaaagaaccttctccaagggcatttcaatatcacttaagatatggttgagattcttacggttgatttcttctaaaatagcgtcttttattatgggaaggtaggcaacaaattcaccaaaatattgctcaggttgttctggtagacgacctataggcaatcctgaatttccccattccttagcaaaccggtgagcagtttctgtaaatccgtgatttactaaaagagattgaaaggagatttttcctcccccatttgtcaagtgctcagctaaagctaggtcataagaaatttctcgaattacaattcctgcatttagaagagcgtggcaatcgcgttttagattataaccatagaaagtaagatcttctcttaaaaagaaatcttttaatatagggagtatcttcgtgccttcctcttctaaggcaataaaaaatacccctgatccctgtgtcaaagctaaaccttcaagcttcaaagagagaagatggtttcctgtatatgctacagcaaaggcaatgtcccccccttgcacaaggtttaaaatgttggtgaggctttccgcatctttgattatctgaacatcgactgtcgcagcctctgtttgcttggacggcacaagagttttaaatccttgttgtatataaaagtgtatgagtttctcttcatccacagggtgttgtggaaaggtaagggactctattggtactgggatagggatattagaatccaagagggcaagccgtttactaagctttaaagtctcctgccgttcactcagcatagtttgacttaatcccttcacggcgtctaaattttctaaaagtccctcaacacttccaaattgtttaagaagtgctgcagcttttttaggcccacaacctgggagccctggaatgttatcagaagagtctccaactaacgctagataatcagggatattccctggaggaatcccataacgttctatcacctcagagatccctacaacaccttgatctgcccaaggattccaagctacaacatgatcgtttacaagctgcaacagatctttatccgcggtgcatacgtaaactttataattctcttctctagccttcttagcaatacttgcaatcacatcgtcagcttctaccgactctttttctaagtaagctaggcctattaaagagcagtactctttaactagagctatttgtggagggatgtcttcgaattttttctgtcgattacttttgtaatcagcataaatcgcctgacggctttgtttattattaggaccgtcaaagacggagatcatgtattctggagagaattctttgataagtttatttaaagaacgaataaatccaaaaactgcttgtgttgcttgtccttgatgatttttcatttctggcaaagcaaagtaggcacgaaagataaatcctgaggcatctaatacaaacagtttcttcattgcatattcccttctaggtctctctacagtgccaagtagggaggtatgtatgcagcgtcatgggataaaggcagaatatcgtgtttaatcatgccagtaactaatggacttgaagctgcagctgaagccacccgcttccaccaaccatcaccaccagagccaatcactctatagttatcttcaatcttacaaacagcaactatgtcttgaaggacttgttctttagttgcgcctacaacatcaatatagccttcttgtttggccttctctggagaaaaaatacgtgctccgagagtgtgaactaacttctctttagtaagcagaggacggttttgtgtaactatatcaacaaattgtccgtagagaaaatcaagagtcgcttgccgttcttctctatcatgagaagtccacggtgtataaggattcattggagccttatcttttccagctgtcagcagatcactttcaactccgtagcgatttaaaccttcttttacattgaagaatggtccagaacgcactccgatagaaccgataagagaggaggaggtggcataaattttagttgcagcgcaggatacataatagcctcccgaagcacaaagaccattcacataaatataaatagggaatcccttacgttctttccaaaagcgaagcatagagtaaattctatctatttcaaagacctcgcctcctgggcaatccatatcaatgacaatacctttgacacgatctttaagaggagctttctcaaatccttctaaaatattctgaatcgttttggccgtattttttgaagaagcaattacatctttcatttcgataacagcaataatgggggctgttttccctagatcttttacttctccttgggcgtcaggcaagctaacgaaggtagcatccccatttcctaaagaggaagctatgagtgcgaatataacgacaaaagcaagaacaactccgcaacacagtcctactatcgataaaaaggctttggatacgaagtgccacaacgttttcataacgacctataaattctagtaaattctaaaatggataaaataagggatgagcagaaaagcttaaagatgaaaattataaaattctcatgctcaccgagaataacacagagtttttctatcaacctacagaacagccatttcttcttgttctacagattcctgggcttcacgtacgattgaagaggaaggttctttaggttgtttcaaggttgctacagcatcagcagctctagagtagtattctttaccgatataggcaacaaccgcaatccaaacgaccataataatgagaagaactagggcgatgacgtttaaacttgctgcaacagaagagaaaataacaagcagcccttggtaaattaaagagcctccagactttcctatccttgaaacgacaccatcaatcgcggctttcccatgatttttatcctctggagaaagtgggataaaggccatttccttggtttgatcaaagaacgtaaatttcgtcccccgggataggacattttgcatccctccagtccaggcagctagagccagaggtgtcattccaagaactcccccaaaaatagagatgtctctttttgcagcaaaaatagttccgaaaaagagcagtcctgaaactaacattaccaatggagtgactaaagcaccgacagtccatccccatttacggatacactgtccggtaaggagtacagctgctaatacagaaacgacgccaatgagggtagtgattctactcatatacccattgaattctacgtgagaactgtaaatctggctaacttgatccttccaaacgacttcgaatagatggatcaccaaattataggataggacaataatagcgagccctaataaataacgagactgaatgaggtgtaagaaaaggtttctagctttggctttaggttttttcttttcctttagattagcagtagctgctccctcttctgccaagacacgtctagatggagggatcgaagtatcaatagtcaaatgatgaatccgcctatatagccagatcataattaaaccagaacaagtgatcagcatggtcaagttgagcattacagagtgccaggaatcacatgcaaaggagtaggcaacaaatgtttgtttccccatccaataggagatttctcctgcgcatattgaggagagatttaatcctgtattgataagagcgtaaaaacggcccgcttcagtaattgtagtaatctgattggctagtccccagaacaacatcgaaagaacaaccgaactccacagctctgacattacgtaataaatactgtaactccagtaacggaccatcacaataaaaccacgaagtccttgaggaaggagctcttgtaatttatcagcgagagagttgagatgcaggctatcccctacaggataaatgatcacagcaaacaggaagaaaaaaccaaggaatgcggccatgaagcaataaaaaacggtatcccgaggataccgactgcctaaccacccatagaccatagtaacaataacagctcccgggacaattccccaaaccttaaggaagggaatcacttctgccccagcatctgaaccgacaatgaccagagtatctttcatgtttttcagcaggcagtagttaaagccaacgaaaaacgctagtagaaatagtggaacaaacttagaaaattctgatttataaataggacaaagatatgcccgcagccttgaaaagggtttcacttctgatgactgcataaactccttcccaactttatggcgtataaagacttatagacatttagtttacacccagaagacatcgcatgcttatagctcctataatactggttacttagcaaacggcaaggcataaattaacgatcacgataaaaagagactccattttactgcaacgcgccgtaaagttcaagcggttcgtggataaacttataatccttgctcacaatactttttctttccgggttagcggagaaactgttttttataatccataattctctcgaggaaatatagaaaaccgagagccacgagggggactagtccggtccaaggaatttcaccccctgccgtgacccctagtaaaataataaattgaactactgtaaagatcttgccccaaaataaagagccataatcatagcctttccaacctttaactaaagaaaggtagcagacaaagataataaggaataagtctcgagcgcaaatgaaaaagaggtgtgctattgataaggatccttccatatagaggaccgtgatacaaacgaacacaaagactttatctgtaatagggtctaggattgaaccgagacgacttgtcgctttatagcgtcgagcaagatagccatctaagacatcgcttagcatagctccaacaatagcaagtaagcggatatgcaatttttcttggcagaagtatagcgctagccacaaacgtgatagagaaagtaggttgcaaaattgtctcataattttggctaactagtacgatccttttaggaaccttataattcggccccattatagagcatgctaaatctacaaacaagcatagagttcgctcaaacggtttctcatcttgcaactgttcggctctacattgacatatattaggctttctttaaaaagaatacgaaaaagggtgcgaactacaactagcttgcgttagccaaggtagaggttattcggaaagagagggattcgaaccctcggtaccctttaggggtacgcgtccttagcagggacgtactttcgaccactcagtcatctttccttatttattcatcacagcctaacaatgaattttgatctcactgttattgttaggataggttaactatcaaaatgaaaaatgtcaacttgtgcaaacctgacaagaaaaaaggaaggcaatctcttaaaattcacctctgaactccctatagatttggaaacttgcaataaaaggttctgagcagttcctcgaaaatctctctgagcaactagcacttgagggatatatgctagataacataacctatctagaagtatcctaaaccctcacgaattacgaaagttcgcttctaatggacaaatctactggtgtacctctcccctctcctcctcattcgaaagaatcggaaatgatagttttaggttgcatgctgacaggggtacattatctaaatcttgcagccaaccaactctacgaagaagatttttattaccttgaacataaaattatttttcgagtcctccaagatgccttcaagcaagataaacctatcgatgttcacttagctggagaagaactcaaacggcacaaccagattactgtaattgggggcccttcgtatctaattactttagccgaatttgcaggtaccgcagcctatcttgaagaatacgtagacatcatccgatcgaagtcgattctaaggaagatgatttctacagcaaaagaaatcgaaaaaagagctttagagcagccgaaaaatgttgccgaagccttagatgaagctcagaattctttttttaaaatcagccaatcaacatcggtaagtcagtacactttagttgctgacaaattacgcgggttaacaacaactacagataagccttaccttgtacaattacaagagagacaagaattatttttacagaatgctcaaggagacaataagtctttcttcactggcattcccacacactttattgatttagaccagctgattcacggattttctccctcaaatttgatgatcttagctgcccgccctgccatggggaaaacagcactcgctttgaatattgcagagaatctttgttttcaaaaccgcctccccattggaattttttctttagagatgacagtggatcagctgattcatcgtatgatttgctctcgatccgaagttgactctaaaaaaatctctataggcgacctttccggtcatgactttcaaagaattgtttcggtaatcaatgaaatgcaggaacacactttgctcattgatgatcagccagggttaaaagtttctgatctacgagctcgggctcgtagaatgaaggaaagctatgatattcaatttctcattattgattatttacaattactttccggctcagggactttgcgtgctacagaaagtcgtcaaacagaaatttcagagatttcccgaatgttgaagactcttgcccgtgagttaaacattccgattctttgtctttcacagctttctcgaaaagttgaggatcgggcaaatcatcgtccgatgatgagtgatcttcgggaaagtggaagtattgagcaagattcggatttagtgatgttcttacttcgtagagaatattatgatcccaatgataagcctggcactgcagaacttattatagcaaaaaaccgtcatggttctataggttctgtccctctagtttttgaaaaagaactcgcacgttttcgcaattattcggcttttgaatgtatcagctagttgattcgcaatgcgaatcagagtcaagtagattggacaatccgatttgtcttaaaacccaagaatcagtatagttgtttggtcggctgaggatagcaccatatttgcaaagaaatagcgtctgcatcctattgaaccagagttccgccggaaaaattcaaacttcggtttgaatatgaagaatcttcgtcacttatgacgaaggggatgtcaaatcgatacgttaaccataaagatattatgtcatctgttaagaagaaacgaagactcaagatcgccaagcacaagcgtaaaaaaagacgtcgtagagatcgtcataaaaacaagtagtttttagtaacttatgtggactcacccaattgcttatgatgtgattgtagtgggagctggacatgcaggttgtgaggcagcatattgctctgcaaagatgggtgtctccgttcttatgctcacctccaatttggatactattgccaagttgagttgcaatcctgctgtcggtggtatcggcaaagggcacattgttcgagagatcgatgcccttggtggtattatggcggaagtgacagatcaatctggcatacaatttcgcattctgaaccaaaccaagggacctgctgtccgagcaccacgagctcaagtagataagcaactttatcatattcatatgaaacgtcttttggagaatactccgggccttcatattatgcaggccactgtagagtctctattagataaagaaggtgtgatttctggagtcactactaaagaaggctggatgttctcaggaaagactgtagttctttcttcgggaacttttatgcgcggcctaattcatattggggaccgtaatttctctggaggacgtttaggcgacccttcatcacaaggtttatcggaagatcttaaaaaacgtggttttcctataagcagattgaaaactgggacccctccccgtttactagcctcttctataaatttttcctgcatggaagagcaacctggagatttaggtgtgggttttgtacacagaaccgagccttttcagcctcctttaccacaactttcttgtttcattacccacaccatggaaaaaactaaggcaatcatttcagcaaacttacatcgttcggcactttatgggggctgcattgaaggggtaggtcctcgctattgtccttctatagaagataaaattgtaaagttctcggacaaagaacgtcaccacgtctttctagagccagaagggctgcatacccaagagatctatgctaatgggttatctacttctatgccttttgatgtacaatacgatatgatccgttctgtactggggttagaaaatgcaattatcactcgaccagcttatgctatagaatatgattatattcacggcaatgtgatccaccccacactggagagtaaacttattgaagggctcttcttatgtgggcagattaatggcaccacaggttatgaagaagccgcagcccaagggttaattgccggcattaacgctgtgaacaaggttttcaacaggcctccttttattccttcacgccaagaatcttacatcggcgtcatgctagacgatctcaccacacagattttggatgaaccttaccgcatgtttacaggaagagcagaacaccggctcttattaagacaagataatgcgtgtgctcgactatcgcactatggttatgaattagggttactctcagaggaacgttacgaacttgtcaaaaagcaaaaccagctattagaagaagaaaaggttcgcctccaaaagacatttaggcagtacggccagtctgtagtctctttagcaaaagcactatctcgtcctgaagtttcttatgacatgcttagagaagcattcccaaatgatatccgtgatttaggagcggttctcaatgcctccttagaaatggaaatcaaatattctggatatatagatcgccagaaaattctgattcagagtttagaaaaagccgagagtttactaattccagaagacttagattataagcagataacagccttaagcttagaagctcaagagaaattagcgaaatttacacctcgaactcttggttctgcatcgagaatatcgggcatagcttctgctgacattcaagttttgatgatagctttaaaaaaacatgcccaccactaactgtattttcctagatttacggggacactctattcttcaccaactgcaaattgaagaggctttactaagagtcgcgaatcaaaatttttgcattataaattcaggtgccaaagactctatagttttaggaatttctcgaaacttgaatcaagacgttcatatttctagagcacaagcagaccatattcctatcatacgccgctatagtggaggggggacggtattcatagattccaataccttgatggtatcttggattatgaacagttcagaagcttctgcccaacctcaggaattattagcatggacttatggcatctatagtccactacttcctaataccttttctattcgagaaaacgactatgttcttggtcataagaaaataggaggtaatgcacaatatattcaaagacatcgctgggtacatcacacgacatttctgtgggatatcgacctagataagttgtcctactacctgccaattcctcaacaacaacctacctaccgtaatcaacgctctcacgaagaatttttgactacgttacgtccttggttcccctctcgcgatgacttcttggaaaggatcaaggcatctggtagtttgttgtttacctgggaagaatttcttgataatgagctagaagaaattcttgctcaacctcatcgtaaagcaactacagtactaaactaaacgagaggtttcgaagcgttaacaacttctatcttactgaagaagtaagcgatttcgacagcagcattttctaaagtatcagatccatgaacagcattcacgcctatagattccccaaacttagctcgaatggttcctgaagcagcttctgcaggatttgtagctcccataagttcacgatttcgggaaacggcatttgccccttccaatactaaaactacaacagggcctgagaccataaaatcaacaagttcttggaaaaaaggacgctctctatgcacaaaataaaacccttcggcttcagtttgggataggtgcatcattttcatagcagctatacgtaatccagattgttcaaaaatagataagatctctccgatatgggctttgctaacagaatctggtttaataatggatagcgtttgttccatggtgtatacatatctcctttaaataaaatcgttttattttaggaggagtatagcatgatctttaggaaagtctagtccttgttcactcctgaaaaattctttttcagagcgataggaaggatatctgttaaagaagatccctcagggagatctttgattgcttcggcaatcatacgttcagcagcaatttttgaataacccaaagctgctaaagcctgaatgccttcctccaagcaagaagaggtggtatgtgtttggctggtctccactctcgagtctagaggaagtaaatctggtaatttttgtttaagctcaaccatgagtttttcagcagtttttttcccaattcccgatacggaagctaaagcacgaatatcttcagatcggactacagaacatagtacctttaaaggtagcgcattaagaatcgcgagggctagcttaggtcctattccagaaaaagaaattaaaatacggaaacactctcgctcttctcgagaatgaaacccatagagcaagtgttccgtttcacggaatatcacatgagtgaagacgagaaagtcttgatgtaaagccctgatgcattctattgcccaacgttctgtaatagcaatatggtagccaataccttggcattctataacaattgcaccagtatgcacataggtcagtgttccacgaatatagtcgtacatcttatctcactccacaaagagggctacgcgctacatgagtatgacatatagcaagtgcaaaggcatcagcaatatcttcattcgaagggtgcaaaacttcgggaacatttagaatcttgcttaccatcacctggacctgtcttttacttgcatgacccttaccgactactgctttcttagcaacatttggggcatattcaaaaatgaggatatcacgctgagctgcagccaataaaacgattcctcgtgccatagctaatttcatagtactttgaggattcttatttacaaattgcgtttctaggaccatagcattaggttgcgtatcatctaatactcctgagagttgctcaaacaaagtcttatagcgcataggcagtggcatgtcggaagataaacgaatggcaccataactataaggacgtaattgatagcgctgttccactgcaatgatggcatatcctgcgactatcgttcctggatccacacctataatcagttctgacacaatcgattcctgaaatactttgaacttattgtctttaaaagatgatcctaacctagataatcacttctcaagtagtgaattctcggtttctagaaaaaaatttcctgctatttaaaacagtcctgtttactacgtaggaatcttaactccctaaagatttagattctgagaatactacgtctacttcactctcaggttctttgcctaaaagtcctttcaaatgatctaactttgtatttgaaggcatagccatacctttctctttatgtagatctcgaagctgacaatattgatcctcaacaatatcttggagtaaggctatggctttctttttttcagctagatcggtttgcacctctgttaacttctcaatagaacaaacctcagagctagtttgagctccttcttgtcgctgtaatttttctcttaacttagcaatctctgaatgatatgtttttatataaatatctttttcttgttgcaaatctataagacttttcttcaaacggttgatctctgcatatgcggctgaagatttgtcttcttctatctctatagagggggctccgtgttgcgaaacataacgctgtagttgttcttccagctgtttaattttatgctcatagcataaacgacgcccttcactaatttctgttcgctgtacactttgaagcagttctttttttatctcgtcgataatatcactttggtgtcgaatttgttgtaatttctcagcaaggcgattttgcaaccaggtattttcttgttgtaacttttctaaatcttgatttttagcttcttcacgacggcgatattcttcttccaaagcagatagctgttcccgatactgtaagtgaatacgttcatgctcctgatgacaagagtcttgggtttccttctgcaaagaaaccaactttccactcattctgctacagactcctgaaagaatattgcaaatctgctgccattccataatatcagcatctttccagcgacaaagcaaatgaagcatggaacgggagcatgaatgataatagtgaggggataatgaactggaagatcgtagcgagaagagatgcagcttaagtatagataagagccgcacagagtacctctaaaattaacctaatcattcatcgtatagcatacgactgagttcttgtcctaattcgtcataagtgacttttaaaaagacaggcaacttatttggataactctacagattaaaaaacttagaaaattgctcagaacaagactcgaacttgcacgggcctacgcccaagggattttaagtccctagtgtctaccattccaccatctgagcacgaaaagacagtctgttcagagaagccttcaattaaaaggcgtgttctttaaagatgatctttttccataaggatagaaaactaaagaacatcttatcacagttttttttctagatcaatgatttttcaaaaaagggaaaggtatgccttaagttaaagtgaacttaaaccatacctttaaaaatagctattcttcttctgtagcagaagatgtttcggggaagaacattgcagaagactcttcaaaagaagctgaggtaggttcctcttctgtctcaggaaaatgtatagcatcatctgccgatagcaaagcattgatgagatcgctgctctcacgaaccaaagcttgtaacgactcgttaagatccgcagaagtaactactggatctacaacagtttgagagataacttcggagatcaactttgctgggggtggaagtaaagaaaacttcttctgttcaacaatctcattttcttgagattcttcccaaagctcttccttaacagtatccaagatttcttgagatgctccagttacttcagcaatctctttatgatttctacgacggctgagctttttcttttccttccacttctcccctttaaaggaatctttccttgcctctttcttttcctttttactaggagatgtaggctcggttccttcctctgggctatcagctagaggcttctcatcaatcacaggaagcggagtcgatttggtcaacttgattagagcttctctaccaccagcaattttcactccacgatctaaaccgacagctttcaaattgattttagtatcacggacttccataacctcatagtctccggcagggactaaaaaaggtttactatgatcacagttacggaaaaaacaaatatttcctaaagagatcacttctatagcttcaaccataaaaggatcttgtgaaaaatgctttgtattccttaccgacaacttatacccctctcgagaggtaattacagtttctatgacggggtctcttgtaaaatacacgtaattataaccttttatttagagtttttttctacatactctaataagtctactatacgcgtggcatatcctgtttcgttatcataccacgcaactaacttgaagaaccgatcattcaaagcgataccagctagagcatcgaatatcgaggagtactcagatcctataaaatctgaagaaactacctgctcatctgtataatctaaaatgccttttaaatcagtttctgaagcctgtttcatagctttgcaaatgtcatcgtatgtcgtagacttatctaacctgacggtcaagtcaactacagacacgtcttcgataggaacccgaaaagccattcctgttaattttccctttaactcgggaagacatagagttacagcttttgcagctccggttgaggcgggaataatattttgtaaacatccacgacctcctctccaatctttcttagaaggtccgtcaacaactagttgagtagcagtagcagcatgaactgttgtcatcaaaccttctgtaattccgaaattatctagtaaaactttagcaataggagctaaacaattcgtagtgcaagaagcattcgatataacaaagtctttttctggattgaaagtcttatggttcactcccataacgaaagtaggaatatcaccttttccaggagcagagattaagactcgtttcgctccagcttgaatatgcttctcagcatcttctttttttgtgaacaatcctgtacattcaataacgagatcaacccctaaatctttccaaggaagattttgaacattgcgttcagataaaaattgaatttttctcttcccaacgatgaggtggtccgcttcacaacgtacatcctcaggaaaacgtccatgtgtagagtcgaatttaaatagataggtaagcgcatccccaggaacaagatcattaatggcgaggacttctactgaagagtttctctttaagatttgtcttaaaactaaacgaccaattcgcccgaaaccattaattacaactttcatcgcttaccctcagagttcaataaattggaaattgattagctttagctagctaaaaactctataatacacttttgagcattatcaccaattctattttgcagttttagaatacgtgtgtaaccaccttttctttctacaaaacgattccccaactcatcgaataacttattcacaaccaaacgatcgacattatatacagaggtgtctccacctttagcttgtcgagcttctttgcttgttaatttattgtatctgaccataagccgtccaatagctatacgtcgtgctgctaaggagttttttttagctaaggtaatcattttatcagcatgtcggcgtagttctttagctttaggcaaagtagtctcaattctttcataatgaattagagactttaacatgttagctaacatacagcgattatgcgaggaagtacgaccaactctaaatttttttctagcgtgttgcattacttactatccctttgtatttttagcccgaatcttttcggcataccacttcattttttcttttacgttatctaaacctacgccaaattgcgttaggtccattcctaattcaagcttcatttctttcaatttattcttgatctcacacagtgatttctttccaaaatttctgaattgtagcaatcgaggttcaggcataataacaagttcgccaatagtctcaatatttgcattagacaaacaatttgttgatctgactgagagttctatttcattaattcctaaaattaacttatgaagaatatcatctttgttttctttctcaatagaaatagcttcttcaaatacgattttcttctcatccatattttcaaaaatggaaaaatgtttagtcaaaatttgagttgaaaaagccagagcttctttcggagtcactcttccatctgtttcaactattaaaactaaacggtcaaaatctgtatcctgacccacccgtgtatcttctacaaagtagttgactaaagtgactggagaaaaggctgcatccaaaacgatttcataaacacccttatcttccaaaacaatcctttcagaaggtgtatatcccctaccaaaagcaattcgtagaacgacttccaactgtatgggttgagtaacagtaaaaatgacttgatctgggttaacggcttcaaagtccccttcttgcaatagatcttgtagagtcacttctttttgtccattagctgcggctaaatcggaagcatctatagaaattgaagcttttaagacctgagtggttcttcctaaagaactatcctgcatggggtacttttttaatagggcaccttttaaattcagaatgatgttagttacatcctcaataaccccttcgattgccatatattcatgaagtacgcctgtcatagcaaacgagataatagctggagcttctaaaccaataagcaaagcacgtcttagagcatttcctaaagtgtggcccattcctctttctagaggctcagcaatgaagcgagcatgtttgtctattggaagcccttcaacaggcaacattttaactgcttcaggcagttcaaacttatcataaagtaaattgtgtgcgttatctgacatccctttctccttccctaaaactacactctgcgcctttttcttggccggcaaccattatgaggaacaggagtttcatcacggattacagaaactaccaaaccagcagatatcaaagcacgaacagcagactctctcccagctccagtacccttcaaacaaacctctacttcctttaaaccagagttcatggcagttttagcagcgtcttgagctgctacagtggcagcaaaggctgaagattttcttgaaccagaatatcctactttacctgctgatgcccaagaaatcacattaccagcaggatctgttatagatactattgtattgttaaaggttgctttaacatgcacaacacctgaaggaatattttttagttgttttctttttacgctcttttttgcctgcgcttgatttttaaccaaaacacgactcctaattaaaaattatttcttcttacctgcgactgtttttcttttaccttttcgagtacgagaattagtttttgtacgttgtcctcttactggtaaagaaagtctatgtctctgacctcgataagaatggatggcgatcaatcttttgatatccgattgaacacgacgtcgcaaatccccttctacggtatattctgattgtagcagagagttcagtcgtcctacttcttcttcagttaattcagaggctcttgcctcaggatctaacttcaactttttaatgatttcatcagaacgagctgatcctattccataaatatatgtcagacttatttttaactttttctttgcaggaatatcaattccaatgatgcgtggcatacgttgggcctcccttaaaatagtataagcatcttaggtcaaaaattgttatttttcaatgtcttcctttcgtccgatctgttttcagcacgctatcgtagcgacgcattaacaaaaaggcatcaacctgcttcattgtatctaaaacgacccctacgacgataagcattgcagtaccgcctaagaaatagcttacattagaatccacacgaagcagacaacctaaaagtgaaggtaatatcgcgatcgccgctaagaacaacgctcctaaaagggtcacacgattcattgtatactctaagtaatgttgcgtaggcttgccctgacgtatgccaggaataaaggcattattttttttcatttcagaagcaatttgttctggatgaaattgtgtggctgtccaaaagtatgtaaaaaatataatgagcaacacataacatatagaataaactaaactgcctggagcaagtaaagctgctatacgcttcatccaagaagactctgacgcaataaactgtcctatagttgctgggaacatcagtagcgaggaagcaaaaatcacaggaatgacgccagcatagttaacttttaaaggaagataggaccctccaccggggacttctcttcttccaattacccttcgagcatattgcacagggatttttctcactccctcgataatcaaaatcgtagtaatcagaacaaaaacaaaaacaagagcaaggattaaaattgaaattagacccaaatcagaggagtcttgagatcctaaatttaacttattaacaatagatcccaatacagaaggaaatgaggatagaattccaagggcgataattaaacttatcccgttcccaatccccttatcggagatctgttcaccgatccacatcaataagagagttcctgtagtcatgactacaactgtagtgatataaaaaatccaggggactccaaatagttttgaagataataaagtgggcagaacaatccccggaatagttagattcattctaagagcaaacttagcaaataagagagactgtattacagctaaagcaacggtaaacaaacgtgtgagtctaccaatcctacgtttcccttgatcagaagactccctcatttctctttgcagcgcaggcataaagactaggaacagctgaacgataattgaggctgaaatgtaaggaaccacacccagcgcaattacggtcatttgggcaaaagcgcctccagaaaaaatatcagctagttgaaataaattctgacctgatcccaataactgcttgaagtaagctacagctaattcaccattaattcctggaacaggaataaatacacccactctacaggccgtaagcaaagcaaaagtatagaataacttttgtcgtaattcggtaatcagaaaaaattgtctcaatgtggtcatatacggcctaaacaatcttattttttaagtaatgcctagcaaattttgtactccttgcgataggactacagcagtatcttgccatacaaaagtcttttccaaatctcctttgagaatgactttgactcgtacagcttgtctcgcaatggctttctttgcttttaatgcatctaaagtaattgcttctccttcttggaaaagctcggctaaacgtcctgtagtaatttcttcaacgcatttatcaaaacgtttatgagaaaaccctcttgtaggaactcttctatataaaggaactcctcccccttcatagccaaaacgacgtttgtatcccgaacggctaccgtctcctttatgaccacgaccactggttttcccatgaccggaagaaggaccacgacctaataatttttttcttcgtttacgttcagaaatatcaaataatgattctaacttaatcatttatagccgctcctcttcttaacaaatccttacgtgggctgagtcctgtaagagctttaaacgccgctttcacttggttcatagggttattagatccgaaacttttagctacaatatctttaataccagccatttctaggatcaaacgaatacgagaaccggcaacaattccagttccaggttttgctggttttaacagcaactgtgctccatcgtgatggacaagaacttcatgaggaatagaaccatcttctaaagcttctatcttcattaaattcttttttgcagcttcaccacctttacgaatggcatctgtgagttcattggctttagcaaaaccatagcccaaacgacccttgccatctcctactaaaattaaagcagaaaaactgaactttcgtcctcccttaacaactttggagcaacggttaacaacaagaactttctcttctaattgatcttctttatgagaattctttgatagcgacatctcttcctaaaccttcattaaaactgtaaaccaccctctctagccccatcagctaccatagaaacaattccgtgatatttgaaaggaccgcgatcgaaaacaactcgatcaagttgaaggttttttcccaattcagcaatttgagttcctaatactttagcaacttcttggttttttttagtcagaccttgactcttatttaattttgatagagtggaaacggaagccaacgtcttgccgatagaatcgtctatcaactgtacataaatatgtttatttgttttcactacggacaaacgaggctttgtaggggaaccttttaatactttacgcactcgcaaagctcttcgtcttttcattaatgactttttacataacgaactttccataaccctcgacctattttttgcctgttttcgcagctttaccagctttacgacggacatattcattttcataacgaattcccttacctttataaggttcaggaggacgtttggcgcgaatacttgcagcaaattcaccaaccaactgcttatcaagccctttcactgaaatcagagtatttttttcaactgatacctgaagagtagatgggataggaatttttgtagggtgagaaaccccaatggagagatccaaaaatgcaccttgaacagaggctctgaaacccactccaatcatttctaaacgtttttcaaatcctaaatggacaccttgaaccatatttgaaatgagcgcccaatataacccctgcatacagctaggtctatcgacaacatggggagctgcgtgtacaaatatactgttatcttttaaggtgatttctacttctttgaccgatttctgtgttaaggaccctttaggaccttttacaataattttatcatcttgaatcgaaacttctactccttgaggaagtagaataggttctcgagccttacgagacatgctttaccgtcctatacttaatcctgttaccacaccaaacagagcaattcgcccccaatattcttagatctggctagagaaccttccataactccctgagaagtggagaggactgaaattcccatatttccaaagacgtaagggattttcgcagccgatacatagactcttcgagagggttttgatacccgtttcagttggtgtattactggtttacgatcatcggaatattgtaaaaacacacgcatagcgcgtttgcggttttcttcctttactaaataatgagccacaaaacctttatgcttgaggatttttacaatagcctctcgcattttactgtgctctacgtctacatacagatgttctgccatcaaagcgttacgaattcgcgttaacaaatctgctatagaatcacttgtcatgcccatatagatccttttcctctttattgagctttcttaaatcgtaagcccatcaactctaatagagtggtgcactcatcatctgtttgcgcggtagttacccatgtgatattcaatccctgggtgcgcttcacacgatctaaattaatttctgggaaaatttgttgatcgtctaatcctacagaatagcaaccccttccgtctcctttattagaaaatccgcggaagtcgcgaatccgtggagaaacaatattacagaaacgatccataaaatcgtacatacgaattccacgaagggtaacttttgcaccgattccttgaccttctcgtaatttaaaaccggcaatagaatttcgagcttttgttactaacggtttttgcccagagatcatggtcaattcttctaagtgggcttggaataaatttttatctttagcggcttcagcaagtcccatacttaagacaatttttttaagaacagggatctgcattttatttgcatagccaaacttttcaaacaaagatttgcgaatttcttcagtatagaatttttttaatctactcatattagcctttctttcccctcactagacgatacagctgggatgttccgtcagggcgtctttgccacaactcccgcccctgttcagtcactttgacagagagtttggcaggttcaccagctatggttaaacgtacattagaaatatggataggagcctctatactaatccgtttacctttaggattttgttgactacgttttatattttttatgcgaacgtttacaccttcgacaactactttatcttcagtaagagaaaggacttttccttcttttcctttatcattaccagctaatataaataccttatcaccaacacgaatgttttgctttttcataacttccttctccttaaattacctcaggagctaaagaactaatttttataaaacctctatctcgaatttctcgagctacggggccaaaaatccttgttcctttaggatttcctttatcatcgataattacacagctatttgtatcaaattttaaagtagacccatcttttcttgtaatatgccgacgtgtgcgcacgatcacagctttgataacgtctcccttttttatagaactattaggttcgacatctctaactgagcatacaatgacatctccgacagtagcataacgtctacgagaacctccaagaaccttgaagcattttacttttttagctccagtattatcggcaacttttaactgactttcttgctgaatcataatctctatctacctaatgttgctaacttaccacgccaacatgttctataacgcgccatcttttaagcttagacaaaggtcgtgtttcttgaattttaactttatccccttcagaaacttttagttcagtgtgagcgtaatatttctttgaacttctcactactttaagatactgaggatgagaaaatatcctttctactcgaacaacgacagttttttccatttttgccgagacaacaacaccaatcttaacttttctagagcctcttggttcactagccatggactttaccttttctttcttgttttactgttagagctcgagcaatatttttcttatgcgtagaaaacatatgaactttcacaactttgttttgcagtaaattttctgctcttaaagcaaacaaagcctttttgttttcatgaacatacgcatctaaatcgtcgtcgcttttgccccttaactgggtcaataaatcctttttagcagccatgtttataccctttccactcgcttaacaaaacgtgtttttattcctagtttggcagcagctcttcggagggcatcttgagcatcttctttagagacattcgctacttcaaacaatatacgtcctggacgaactactgctacccaatgatctggggcccctttacctttacccatacgagtttctgcaggcttttttgttacacttttgtctggaaaaatacgaatccatacttttcctcgacgttttaaatatctattaatcgcaaccctgcaggcttcaatttgacgactggtgacccagccacgctcaagagtttgcattgcatattctccgaagtctacaaatgtagctcccttacttaatcctgcaaactgtcctttttgttgcttacgaaattttgttcgtttaggcattaacataataattcactcatccttatttacaactttaagcagctgcagagggtgctgccggattgttaggagttgtagaagaggagttctctccaagattaatccaaacttttataccgataattccgtaggtagtttccgcacaagctgtagcataatcaatgtcagctcttagcgtatgaagcggcacacggccatttttataccattcagaacgagcaatctcggctcctgctaacctgcctgaaacttgaatttttacaccaacagctccagcatccattactgattgcattgcctttttcatagcccgtctaaaagagactcgacgttcaatttgtcttgcaatgttatcagctactaattttgcatttagttcgggacgtttaatttccgcgatttctaaccagacttcttttccggtaagagctctgagctcttctttaagcagatcaacttcagcgcctttttttccaattaccaacccaggacgagcggtttggatggtcacttcaattttaccactcatacgacggacaacaaatccagcggcaccttgacatgaaggtttttttcttaaaaactgtcgaattcttacatcttctatgagaaatttaccaaattcttgtttatttccgtaccaaagagaacgccatctttttgtaacccctgtacgaaatccgattggacaacctttctgacccatgatccttcttcccttttaccgttccttctcaccaacaataacagtcaagtgactggtacgttttaaaataggagagcgtcctcctctactttttgatttagatcgcttgtagacaggcccggcatctactcgaacttcggtaacgcttaaattttcacgctttatattttcatgcaattcagcattagctacagcgctatttaaaaccttttttaaacatcttccagctttcaactgagaaaatcccagctgttcctcagcctcttgcacacttagatttctcataagcccagcagctaatctagctttacgaggttgtacccgaatatatcgggcggtcgctttaaacatgctatgtctcctttagacttaccctttcttcacaggatggcttttaaatatccttgtgggagaaaattctcctaatttatgacccaccatagtttctgaaacaaatacggttaaaaatttcttcccgttgtgaacttcaaacgtatggccgatcatctcaggagtaatcattgaacgacgagaccatgttttgataggagtttttttctcctctatgttcattgcacgcactttttttaggaggtggtgatcaacaaacggaccttttcttaacgatctacccataatccttatttcctacgatctttaacaatccatttattacttttgttcttgtcacgtgtttttaatcccttcgtaacctttccccaaggtgtacgtggaatataaccattatggcgaccttctccaccaccgtggggatgatctacagggttcattgcagtaccacggactgtaggacgaactcccatccaacgtcttcttccagctttgccatctacacgtaggttgtgatcggcattggaaacttcaccaatggtagctctgcatccctcatttaacatacggaactctccagaaggcatctttaaagtaacgtatcctggagacttagctataacttgagcagctaatccagcagatcttacaagctttccacctgaagaaggacgcatttcaatattatgaactgacaatcctaaaggtatgctttttaaagtcatacaacatccgggcttaaatggacttccttcacctgaaacaacaacgtctcccctttggatgcctttaggggcgagaatgtaacgtttttctccgtcttcgtagcttaagagagcaatgtatgcagaacgattaggatcgtattctacagtaactactttcgcagtaatcccatctttattacgtttgaagtcaacgaccctatacaattgttttgctcctccgccacgatgacggcaggatatatggcctaaattatctcttccaccagaactcttcttaaagaaagagagctttttatttggtcgaagacttctttttgacttcgtaccgcgcaactcaccacgcgttgttaactcatcaaaagcgggaaggaccagctgtctagttcctggagttactggtttaaattttttaaacatgctgtttatctctctaataaattatccgacagagtgcccttgatagaaagttacaattgctttcttaaatcctgaggtttttcctttacggcgccctcgaaacatgcgggcgggttgaggttttacatttatggtgttcacactctttacttttacatttttatcaacgtaaattgcctctaaagcttgggcgattaatggctttgttgcatcatgagagactataaaaacaaatttagggtctttacaaaagcttccctttttctttccctctccagttccagcgcttaaatgctctaacattttagctttctctgttacgtagtgacgcttaattacatcataaggatctttcatatcctaaaattccttcttaatctttcgtttcagaaacaagacgctcaacaagttcctgcaaagcttttttagaaataacaatattatgagcagaagctaagtcatacccattgatattgattccatagacaaaacccttaactgcagtgaggttacgcaaacttaatcttaaattttcattcttctctacatgatctaagtgatcaataaagagaatgctacgacactcaacattgcaatcttttaaaaaccttaacgctgactgagttttaggagctgttaaagcatctacaaagaccgtatcgtcaactacagtcaatttgtttgtttgaattttttgcgccaacaaaagcctgattgcggcttttctttctttacggtttatacgtacgtgttgattaaatttaggcttaggcccaaaaacaatcccacccccacgaaactgaggagaagctaaacatccctgacgggcattacccgtacctttttgtttgaaaggtttttttgtagaatgactcacttcagaacgatttctagtgcatgcagaccactgtcttttattcgcgcgaatagcaacaatataatccttgatcaattgaaggccatcgccctcatctgcaaacaaagagtctgctacttcaacttcgcctattttatttcctgaaaaatcaaattttgataataaaaccattaggtcctctctgtatcacccctgtccgtatcctaagttctagaagaatgtttcactataacaatagagcctcgcgctccaggaatggcacctttaactaacagtacttttttttctaaatctacttttattacttctaaattttttacagtaacgttctctgcgcccatatgactaggacgcttacttccagggaaacaacgaccaggagtcgatcgcattcctatagaacctgcatgacgatgaaaccctgaaccatggcttcctggaccgccacgaaaaccaaatttcttcatgacaccttgaaaaccttttccttttgaaattccacgaacatcaactgaggaaacatcttcaaaaacttccaatccaaaagcatctcccaaagacaccccattaagagcctcttcagaacctcggacttctttaagaaaacgaaaaactcgaccaccagctttacgcaaatgtccgagtttaggcttactaacacgttttgtaattgtatgagcgggggcattcatttcttccgctcctatttgcaaggagaaatatccgtcgctttccttagttttgatctgggtaacaacgttaggctcaacgcgaattactgagcaagcaaccaaggatccatctttatcaaagatgtgaatcatcccttctttttttcccatcacactaatatgagaccgcataaacttatccattaacaataatgatttgctttcctcttggaggaacaaagaaacaaatctgcttagtattttacttatcgaattctctaaaaagaaaaggaaattttcccttaagaaaataaagggacaggttatcagagggggaagatttttacaataggaaaagtactctaggtactaagaactcaaagataaaagattcttggaaaattcctatttatagaaatagaaagtcgcttccaaaaaattttttagaagcgacttctttaaaataaagataaaactagcttatttgccagactttgttttctgccatatgctatataagccaattcctgcggatgctgccgtcaaggctccagaaattgcagcggagcaagccactgtaatcggtaaaggaatgagtttgactccatccactaccaactctaaagctttttcaagaagagttaaaacatttctttttagagtagcaacgtgttctttacgtaatgccctttccgcgcttagaatcacgtccccactcaactgagattgttggttttctaaggcacatctctcattgtatagggattccttcgcacgtttgaacagcttttgttctaatgcgattccgccaacagcaccagcaactcctgccatatgattaatggtcataattccagcaacagccgtgccaaaattgcctacagtcgctttgtctaagaatggttttgctgtgagtttattgattaacattaacggacgtaaaacaccgaatgtcgctgagtaagtcgttgcaccgactgccgtacaagcttccctggaagctgccaataggtaatcacctcgagttaatagcattttactatactccccaggcgtttttctttcttttgtcttgcttcctaactcgaaggcttgacgtgtgtattggtaacacctctgagtcgagttaacgatagatggaacagctccattgagcacattagctaaggcaacaacttctcgagttgtttttaacataccctgggcgtttctcgcggaggtcaatgcgtcccctgtgcatcccgcctcttccagcgatcctacgacacagtcagaaaccgccttacttagcttaaagcatttatctaaactttttgttgcccctacaaactttgctaacttattcccagggtttgtaaaaaattgttgaatacaataaatccctttctgagcaaaggagctgacagccgctggttctttggcaactggcagcagcatcttacttgctgcacttcctgccgatctaattgcgttagtcgccatttttacctccttacaaggctttttaaaaaaaaattagagcctataataacataaaacgacttaatttagtttaaatgccctaaataaaaaacacgttgtaaagttaattatttaaagtaaaaactatttttaatttctttgctggatagccgtttaaaaaggattttgagttcgtagaacccttgccttctacctgcacttcgtgcaagcaaatggctccctcagaacaggcaatagcaagctcttgcctatctgttacaacaacagtcccgggggctccatatcttcccgcctctgctaaaagagaggccttacggatcatcaagcgttttggcgctttttcagaaaaagagaatagggtccacgctcctggagctggcgtgactcctcgtatatgagcataagcctctttagcaggtttatcccaaggaacctgtccttcttccttagacaattttggcgctattgtcgccaaagcagcgtcttgactgacgagttgcagttgacctgactcaatttgttgtaaagtttttattagaacttctgcgccctgcgatgcaagagcatccgccaattctcctgaagtcatatcaggacctatggggacacgcgtaatatttgccatgtcgcctgtatccatacctgcatccatacggatgacagtatttccagattctgtagctccttccataatacagcgttgtatgggagctgcgcctcggtaggctggcaagagccctgcatgcagattgtaacaaccataacgaggaatatcgaggactatctgacgaagaatcgctccataggcaaccacaataaaaacatcagcattaaaagcccgaagttcttcaataaattgggggtctgacgctttactaggttggagtaaaggtagaccgtgagttagagctatagtttttactggagaaggaatgagttgtgccgatcttttttggggcttatcaactcgggtaacaacagctgtaatttggattttgtgatgcaacaaatcttgcaaaacggtggctgcaaatgtgggtgtgccgaaatagacaaccttaagattcaatcaaaactccttctttgtctgcgctttcttcttcaagggcttgcttatctatgcttcgttcgatgccgcgcttacttgggctttgacaaaactcaatgaagttttttacttctggaatgtctccatattcttctagagtttcttctagagattcaaaaaaacatccgtcagcacgataaatctttttaaaagccttaatgagggctaatcgcgtagcaaaaggaacctgcctacgttgtagtcctactttattaataccagcgagttggtaagggtttccacttccaatggtatagggaggaacatcacgacgaatcccactgagggctcctaccatagcatgcgctccgatgcgaacaaactggtgcactccaaccatcccaccaagaatagcgtaatcaccgacttgaacatgtcctgcaagttgtgcatggttacttagaacgacattatttccaatagtacagttatgggcaacatgagcccagggcataatcaaacaattattcccgatagagactgttgtaccttcgaatgttgaagacgtgatgatagcgaactctcgaatttcgcaattttcaccaatagtcacataggttttttccccttgatactttaaatcttggggtttattaccgatcattgcagagggccatattgttgtccccttgcctatggttgtattgccatcgatatatgcgtaggacttaacaacaacgttgtcacaaagggttaccgtagcttttataacaacgtacggttcaataacaacatcctttccaattttagctcctggctcgataattgcagttgggtgaatgctcgccatgtttctccgtgattatatggattccttatctaccagagcaaagctcagctctgcttcagtgactagctgtgaatctacacgcgcctgtgcccaagctttacctcctttcgatgatattaaagaaaaatctgcttgcagggtaagtacatctccagggcgaacagcttgacgaaacttagctttctgtatccctaaaaataatgcgatacgcttattcctatcattttctagaactaagcctatcaatacaccagcagcttgggccaaagcttctaatatcaagactccaggcataataggcgcgttaggaaaatgccccataaaaaaaggctcatttattgtgacatttttttgtgccgtgatactgcgagcctcgatgtcataagataaaactttatccactaataaaaaaggatatctgtgggggagtaaatctaataattcgcgtaatttgatgacagagggttgattcatttattctttctttatagttctaatgcttccaaaatttttttaccaaaagcaatattggaggagtggccggagccgacagctaatacatgcgcaacaaaaggcctgccaactaaggaaagatctccaatcagatccagtattttatgtcgtactggttcatcggcaaatcttaattgtcctctactaataataccatcgtccttaaaaactacagcattatccaaacatccccctccaattagccccttttccattaagaaacatagctcattgtatagagcaaatgttctacaaggagcaatttcctggcgaaaagactcttcattaatcaccaaagatttgtattgagtccctattgttgaactttgaggataatgcaacgtataggaaatcttcagctcatcagagggaaaggctgctaaaaaaatgtcctgatgttgataatatacaggacgtgttagtctcgcaatggaaaccttatcttcttgttcacaaatacctgcttgatcgattaactcaacaaagacatttgagcttccatcccctatggggatttcctctccactacattggataattagattatctatattgttagatcgcaatgctgccataagatgttcgacagtggcgattacagcactacccctagataatgttgtacttcttcctgtagtgtagacatgatctagtaaagcagggacattttcgtagttacctgaggcagactgtctttgaaaaacaatacctgtatttgtttgtgcaggttgcaaatggagagttgaggacttccctaagtgaattcccactccagaatagcgaacctctcgctttaacgttctttgagttcgttctaacatgtaaaaacctgacaacgagtctccgtatattatcgaatttcttttttagcaagcaagcgatatcctaagaatcctcctcctagataactgactgcacagaaagctatcaaaatcatagggtaatctccacaatacccataaagcgttttataattaaatagaggcaaagaggtttccaatacccctgagggggctttagtttctctagtatcataaggaagaattttgagtattcgacctagagaatccacagctgctgtaacaccagtttggcaagctcgcacgcaaggcatcccaaactcttgatttctcaacatcccatggaggaaatggactttagggagtcgtgattcaggataccatccgtcatttgttaagttaacaaggagttcggctccttgtctcttgtaggattgcaaccgatagccgaaagtttcttcgtagcaaatggtgatcccgatacgaggtaaacctcggacctgcacaactccagaacgtctacctggaagtctcttgcatcctagagcatatttaggaaatagttgtctacaaattagggatccgaatttccctcctggtatatattcgccaccaggcacaaggatacgcttatcgtatcctacggaaattcctttgtgtgatattacctcagcagagttataccaatacaaaacgttctcttttttcacccaccgttctaagccaataattactggacactgaaagtgttgtgacagagctgtggcacaatcactattcgatagaaatgccttaccttcgggaagtggagcaaaagaagacaataaatgtgcgcaggattcatagggatagacttgcctatgcttaccaaaaggcacgactacttctgggaaaatcagcaaatctatgggttgttgtattggggatacgagttggaggagttgttcccagacgactattggggacttaagtttcggtcgtatggggggatgcgcgggttgaacaacagcgacacgcagcgctctcttatcttgttgaaacgcgtgtttaagatactcataatgaattgctccaaaagtatagggcaaaagaagagtgagcacccataacattttagcatgaggttttttcagtagtagacaataaaagctcatatttacagctatgacagcgaagctctgacctgcccaccccaaaaatccgccaaactgccgtccataagcagaggctgtcataggccaaccaagataatcgaaggacatcccagaaaagatcccataaaatcgaagcatctcgatagcgacccatacgccaggaaggctccataaaaaagctgtgcgtttctgacgtacgattgcaactagaaggcaagaaaatcctgaaaatagaacggacaaaatcgtgattaatgtaagccataccaaatagatgagtttgcctatatattgatccgagagcatccaagaaaaatgaatcccctctattgtgaagatccagaaaaaacaggatacaaaaagagtccttagaggtaatgagggtttttttaagggttctagactataccaaaagaatccataaccacaggcggctcctaatatggaaacgaatccacttaaatctggttgagcaaaagctataaggcaccaagaaataacaaagcaaaagattcgtagcacaggctctccttatttcagttcaagccttgcttgacgtcgtcgatctgcttcattataccgacgtttttcttctggagtttctggaacaatctgatggacaggaatgggctggttgtcttcgttgacagcaacaaatgtaaagtatgcggaggtaatatgacgtcgttcctgcttataaatattttctgcccacactttaaccccgacttctagggaagtacgccatgttctgtttactgcagctttacaaatcagattttcccccatatatgcaggagcatagaagcggagggcatcaacaaaagcagtaacacagacggattctgtgtgtcgttctgcgaccactaaggctaaacgatcgagcaaactcattaataatcccccgaagacagtattattagcattaagatcattagggaaaattttataaatatgtccgtcaatacagctaaacgagacgggttttttcttaagcattgttgactctaccgaaaggatttttatagggtattcttggttgcgatagtatcggtcaactgaaagaaaatctatgattttctttcataagttactgaaatttttgattattttttagaaatcgaagtgcttacaattccataaagggattgttaacttgtgaaaatccggtccccttttgtctatgcttgatttcatgacggatagaaaaaagaaggtctgaatcgaaatccatttttgatgcccattgaagataggcaagaggaatttctgaaaaacatcgtcccttgtgtttccctaggggcatatatttcattttaataggttttgctaacacctgtttcagttgttctaacgttcggaaacgtttacaaagatgtttaaaaatattgatattaatttctacatccttcatggcacgatgattcccatcatagggaacattaaagtgtacggctaaggattctagagaattattaggactatctccatattcttttgctaatcggagggtatcaataatggtatactttgagaggaaggtctctccgattctttccatctcttgagcgagaacctgcaaatcaaaaccgacgctatgtcctacgatatagtcgccttctttaaaaaatgctttgatttgaggaaaaacttcggcgattttcggctgatctctcaacatagcgttggagatatggtggactctctgggactccgcagatacaacgcgttctggattgattaaaaattctatcgaactaattacactatcgaaagtaaagcgaacagcggcaatttcaataatacgatctttttttacatctagacctgtcatttcacaatctaggcaagtaaaaaccgtatcttttaataaactcataatttccttctacttcctctatctttgtttgatatccttctgactgtagaaggatttctgtgtttaactttatattttgcatctgtgcagagaatgccttgcgaacagaaaagggttccagggaacctatactattattacatcgcggctcactcttctttatgcctatcagtatgcaaggatactatggagaataaagactagcgcttctctataataatttctctttccatgtttgtttgcatggtaatgtagatatttattgtatcacaaaatcgtggcttaggcaagcgatccgcccattcaatacaaaggacatcgtcttcttctgcatcttgaaaaatgtattcctgatttttctgatcaatccggtaaagatcatagtggcacaaccgcttaggttcattaccataaacatgtaatatagagaacgagggactagcaacttcttccgcgatagtatctccgagatatccagagactatgccacgtacaaattctgtcttaccagccccataatcaccaaataagagcaatacagctcctggaacaaggacttgtcctaactcagttcctagtaatagggtttcttgagaagaatggcttactcttctgtatctacccattggctaatgtacacatgaaaggctgtatcgtctgctaaactttctataaatgctgcgatcttatcttctaccagcgcatcttgcaatagagaaaggaaggaactttccaattgaaacttagtttgattttgcacttcttccagggtcataggacgcaagtagctagagataaaatcctctaaaagagggggtaaactatggaacaatttacctgtaattgccgaagcaaacactgtttttataataggttcttttggtgggactgcgtattcttttatcacatcaggatcttctgatacgaggaaacgcttgattcgcaccccaccctgtttttccatattttgagggcaagaagacagccagtcataaattgcgtcttgagggtttgcatagacgttgtcagcaaagaccttaccggtaaatgggcaaatatagatacgcttcgtattttcgtttacctgtggcttttcagaagaaatttggatttctgtttctctccaaatctttttatcctgttcgagaatacggaccgcatcttctggagttttgaaaattatcttgtcgcgaacaaacaccacaggacgaaggcttagagcctgttccagatagaaaagatacgttgccaacaattctggttttttttgttttcccaaaaactgcaaaagtttctgtttgactgctccagaaatatccatgcctaccctttttcagctaatgacttaacgttcttaagcaaactccccataaaaggaatataaccacatatgggttgtcttacctcacgttaaatcagaaatactatcagagccgagaattatgttgaacataaaggtatcacaacaaggttcatccaaaaaaatctgctgtttttctttaaaaagtttcttaattgtgttttttattatctatagtctacaattttacgaaacgcagctatggcgaaatcggtagacgcgctagattcaggttctagtgagcttatgctcatggaagttcaagtcttcttagctgcaagaaaataacagggacagtaattcgatttttcgagaagggaaacttatggtaaagatcatatcaagtgaaaattttgactcttttattgcatcggggctcgttctcgttgatttctttgcagaatggtgtggcccctgtcggatgctcactcctatcttagaaaatcttgctgcggaacttcctcatgtcactattggaaaaatcaatatagatgagaacagcaagcctgcagaaacgtacgaagtcagctctattcctacgcttattctttttaaggatgggaacgaggtggctcgggtcgtaggtcttaaggataaagaattcctaaccaatcttatcaataagcacgcttaaaaagacgctgcaatattaaaccgtaggattcttttgcaatgctacggttttctgccttaccacttcatataaaacgatccctacactggtagctaaatttagagaacggatgtcttgttgcatgggaatgcgcaggcaatttttataatatttttttaagatctcttttggaagacctttggattcagatccaaagacgtaggtgcctgaagatggcaaggaaaattcagtataagatgctgaacctttggtagaaagacaaaaaatctgatcttcagggacatcatgtagtgcttcttctatagaatccactactgtcaattggagtttgtcccagtagtccatccctgcacgtttgacaaatttatcggctaaagaaaagcccaagggccgaaccaaaatgagttcggcgcctagggctacacaagttctacctatatttccagtattctgtggaatatcaggacaatgaagaactactctcattcaccttgatttccttcttggggtacagcagcaacttcatctgctgaagcctgaatcaagttaatttcaaaaattaataaagagtttggaggaagttgtcctgcggttccgtaagcaagatcaggatggatgtagagaactcgagtttctccttctttcatgccctgcatacctaaagcaaaaccaggaattgtttggcctagaggaagcaagataggctcattgttgccttctgaactgctaaatacttggccattgatgaaggaacccttgtagtgcaatagagctgaaggtttacctgaaattgctttccctgcaccttctttaataattttgtattgcaatttacttggttgcacttcaacaacaccagcgttcttgctattttcttttaagaatttttctgccaatgaaagattttcttttgattttttttcaaaaaccaacttctgtacttcagccattttttcttcatactctgtttctgttaaaggagcacttttacaaaccaattccgcctgcaaccccttagccacttctgcaatatcaaaaaacatatcttctgacttgcgtaattggcgtgctaataaatgaccaaatgttctggataacttttgattatcggataattctatgtcattggtatctttgttatctttatattccactaacgacccctgatccttgtctttatccttagaccgtacgtcacaagaagcgacggagagtgccagagctactgttgctaaaactaaattccaccgtctgttcattttccttctcctatctttgatcttaaggcaacgactatgctacatgcccgaagcaattacaacttatatcaaaaagctaccttaatacttagctcttttaattgggaagacataatttctgagggagcattcatcataagatccgatgctttctgtgttttaggaaacgcgatgacctcgcgaatgctctctgctgctgttaaaaccataaccaatcgatctaaccctaaggcaatccctagatgaggtggggttccaaaactcaaagctttgataaagaatccaaatttttcttggatgctctcaggacttatttttaaaatagtaaatatttgactttgcaagtctgggttatgaattctttgagatcccgaagcaatttcatatccatttaaaaccaagtcatagcttgacgaacgcactgctagaggatctgtttctaacagaggaatatcctcctccaaaggtgctgtaaacggatggtgttccgccacaatttttccatcttctaaagagaaaagagggaaatctgtaatccaaacaaagttatattgattgtcgctatacaattcgcgctcttttgcgatcaatctacgcagatgatcgagagactgattcgctactgattcaggagctgctatcaagagcaaaatatcctgatctttggcatcaaaataagcaaagagttcgtggaaaacctcttcatccataaatttagcaatattggaagcaactttcccctcttgatttttaatccagacaagccccatagccccataacgctttacaaactcggtataaccatcgagttgcttgcgggacatagtagccccacctggaacacaaaaacctttgatcgtacctccgtgagccaactgatctaagaaaatagagaatgaggaacgttttgcatagtctcgacaatcttttaatttaagatcgaatcttaaatctggtttatctgtaccataggaatccttagcttcttgataggtcattttagccaaaggcaaaggaatctctataccttgcgtagcaaacagtgttgcgaccaattgttctataatgggaagtaggtcctgggtatccccaaagctcatttcaatatctatttgagcaaattcaggttgacgatctgctcgcaaatcttcgtctctaaagcacgtggcgatttggaaataacgatccaagcctccaaccattaaaagctgcttaaaaagttgtggtgattgcggtagagcataaaattttccaggatagattctagagggaacaagataatctctagcaccttcaggagtggattttcctaatacaggggtcacgatttctgtgaatccttgagcatccataaagttgcggcaagcaagcatgacctgatgacgacaaagcaacttctcaataatatccccgcgacgcatatctagataacgatactctaaacgcagctcctcattcacattgatgtggtcatcggcaatggaaaaagggagattttgcgacttggatagcacttcaaagcttgcaacttcaacttcaatatgtcctgttgctaagttaggattttccattcctgcaagacgtggacatactttccctcgtacagaaagaacccattcagaacgcacagcatccaaacgttggtgcagttctggttgctcatcttcacggcacacaatttgagtaataccaaaacgatctcgcaaatctatgaagacaacacccccatgattacgataacggtgcacccatcctgccaattgaacattctcacctatatgattacttgtgagttcattacaacggtgtgttctgtatttcatataacaacctttgctctacttcttcttttgttccaaagaattctttacgcagagacatatttttaataactaactgttgagaaattaactctcgctcaccgattaagcaaacgaaagaaacctgttctgtactcgctgcttttagagctccttttacttttttatgagaccaatcgacttccgtagggattcctaaccgtcgcaaatgttgcgaccattccaaacaaaactgatccgcatctggttccattggaatcaaacgcagtttatgagggaactgtggctcaatacgcttttgagctaataacgtttgaatcgctctttcaaggccaacaccgaaaccacaggcaggaagagaagctcctccaaaagctgaaatcaagccgtcatagcgcccgcctccccctaaggcataagagacctcttggaatgtggtagtcgcttcaaagactaagtctgaataataatccaaaccacgcactaaacgaggattgatagcatatgggatttctaaaactctcaaagcgtctaaaatttcattaaaatacttaagatcttcatcagaaacatagtctagaatcgggggcgcttgacggataatttcttgatcttcaggctcctttgaatccaaaatacgcaaaacattcgttgaaaatctctgctggcttaatgccgataattctcccatggactctttcaaataagcgcgtagaaccttatcgtatcgaaatcttgtctcacttcctcctaagaaattgagttgaatttgcatatgttgcaaaccgacacgagagtagaaatcccaaagcaaagcgagaacttctgcatctcttagagggtgacgcacaccaatagcctcaacaccgaactgatggtgttgacgatatctacccgcttgctgacgttcgtagcgaaacatgggaagaatataatagaacttattatcacttcgatgagaggccccgtgttcaagaaaagaacggacaacagcggcagtcccttcgggacgcaaagtcatggaacgaccttttctatctaaaaacgaatagacttcttttttaacaacatcactttcttcccctacatgtaaaaacacttctgatttttcaaaaataggagtacgaatttcacaaaatccataaagcatgcaaacggtatgaattgccttctcaacactatgccaaagtgaagtgtgacgccacaattgtttagcatctgcaagataaggaaatatatcaaagacccctttggggagagttacagtcacgtgatgtcttcgctcaaaatgattacttttttagataatggaatatctggagcttagtgactcctgcctaagcctaagtcatattcacactcgaatctaccctctttttaatgaagggcatttcgcacgaccttgctagagataatccaggagcgcgctacgcgcacgaccataattatatgctagcttatggtttttgtaactaagtattggagaaaaaccgcgccctatgaatgctataaactattcttaaaattctttattaagaagcatgtttacagacgaaaacaaaagataattttgcttttttctagatcgttataacctggaacttgttatagtttacatcccttcattcaacaatcaaacccacccttcataatgtaccaggcaatcgggagaaataggctcgataacttcgtgtacagggaaaacatcctgaacaaagaacaaattatactttgctctggccgcttttaaaacagtcgcgtgagcgtcgtgttccttattggtatttccttttattggaacaagaaatatccctatcaaagcaatcaattttttcattgcatgcgcctcccaaagttaattatgtcacgatgagactttcaaatctggagcagtaaaaatacgctgttttagtatttcttatttaattaaaaataaccaagaaaaacactctactaatgcatctttactctcgcaacctgaaacgattccctccttgttttttcatccttgatatggtaaagtaggcttttcttcgcatttcatctcagtgaaaaagattttacacatggaaattgaaagatgaacgtttggactaaatttttccaacctccaaagcacattaaagaaattgaagaccaagaagtggtcaagaaaaaatacaaatactggcgtattcgtattttctatagcatgttcatcggctacattttctattatttcacaagaaaaagctttacctttgcgatgcccacgctaattgctgatttgggttttgataaagcgcaattagggatcataggaagtaccttatatttttcttatggaatcagtaagtttgttagcggagtcatgtccgaccaatccaatcctagatatttcatggctataggattgatgattacagggctcactaacatctttttcgggatgtcatcctctattgtattatttgctctttggtggggactaaacggatggttccaagggtggggctggcctccatgtgctcgtctactcacccactggtatgcgaaatcagaacggggcacttggtggagtgtgtggagtacctcccacaatattgggggagcacttattcctattctcacaggattcattattgattatagtggatggcggggagccatgtatgttccaggcattctttgtattggaatgggtttagttttaattaatcgtttacgagacacgcctcagtccttagggctacctcctatagagaagtacaagcgtgatccccatcacgcacatcacgagggcaaatcagcctcagaaggaactgaggaaatcgaacgcgagctatccactagagaaattctttttacctatgtccttacaaatcagtggctttggtttttagctgctgcctcgttctttatttatatagtacgaatggcagtcaacgattggagcgctttattccttattgagacaaaacattatgcggcagtgaaagccaatttttgcgtatctctatttgagattggtggtttattcggcatgctagttgctggttggttatctgataagatttctaagggcaatcgtgggcctatgaacgtcctcttctctttaggtttgctgtttgctattttaggcatgtggttttcacgtagtcataatcagtggtgggtggacggaaccttacttttcgttattggttttttcttatacggccctcaaatgatgatcggtctagcagcagcagaactctctcataaaaaagctgctggtactgctagcggatttactggatggttcgcttattttggagctacctttgcagggtatcctttaggaaaggttactgatgtttgggggtggaaagggtttttcattgctctcttagcctgtgcatccatagctttattgctctttttaccaacttggaacgctacggagaaaaacactcgtagtaaagcctagccgttcttgaggattttttttgacctggataccccttcactgtcattctcaatactctgttcttgatgcaatgagctccatcaaagatttcgttgcgaaaggtcaggaatttggaattcccgctctggctctaacagaccatgggaatctttatggagctgttgatttctataaagaatgcactcaaaaagggatccaacccatcattggttgcgagtgttatattgctccaggatcacgtttcgataagaaaaaagagaagcgtagtcgtgcagcacaccatctcattttattatgtaaaaatgaacaagggtaccgcaacctttgtattttaacctccctagcatttactgagggtttctattactttcctcggatagacaaggatcttttgagacagtactctgaaggcttaatctgtttatctggttgtttatctagttctgtttcagatgctgccttaaaatctccggaagctctgcttcttgaattgcaatggtttcaagacctattcaaagatgattatttcacagaagtacaactacacaagatgtccgaagagagcattgcaggctttaaagaggaatggttaaagcaagaatattactctctcattgaaaaacagatcaaagtcaatactgcagtgttagaagcaagtaagcgcttaggcattcctactgtagctacgaatgacatccattacatcaatgcaaacgattggcaagctcatgaaatcctgttgaatgtccaatctggggagactgtgcggattgcgaaacagaatactcatatccccaatcctaaacgaaaggtctatcgcagtcgcgagtactattttaaatcccctgcgcaaatggcagagttatttaaagatattcctgaggtcatttccaacacattagaagttgccaaacggtgtgattttacttttgatttttccaagaaacactaccctatctatgtccctgaatctttaaaaaccttaaacagctacacggaggaagaccgttatcaagcttctgcagtcttcttaaaacagctagctgaagaagctttgcctaagaaatactcttctgaagttcttgctcatattgctaagaaatttccacatcgggaccctatcgatattgtcaaagaaaggatggacatggagatggccatcatcattcctaaaggaatgtgtgactatcttttgattgtttgggacattattcattgggccaaagcaaatggcattcctgtaggccctggaagaggttcaggagctggatccgtattactatttttgttagggatcacagaaatcgagcccatacgatttgatttattctttgagagatttatcaatcctgagcgtttgtcttacccagatattgacatcgatatttgcatggcaggacgtgaacgtgtcattaattatgcaattgagcgtcatggcaaagataatgtagctcaaatcattacttttggaactatgaaagccaaaatggctgtcaaagatgtgggaagaactttagacatggccttatctaaagtgaaccacattgcgaaacatattccagatttaaatactacgttgtctaaagctttagaaacagatcctgacctacatcagctctatattaacgatgccgaatctgcacaagtgattgatatggcgctttgcttagaaggctccatacggaatacaggggttcatgctgctggtgtgattatctgtggagaccagctgaccaatcacattccgatttgtatttctaaagactccacaatgattacaacacaatactctatgaaacccgtggagagtgttggaatgcttaaagtcgacttattagggctcaagactttaaccagtatcaatattgcaatgtctgcaattgaaaagaaaacaggacaatcgctagctatggcgacactgcctttggatgatgccaccacattttctcttttacatcagggaaagactatggggatatttcaaatggaatccaaggggatgcaagaattagcaaaaaacctacgccctgacctctttgaggaaatcattgctatgggtgctttataccgcccaggccctatggatatgattccttcttttattaaccgcaagcatggcaaagaaattatagaatacgaccatccccttatggaatccattcttaaggaaacctatggaattatggtctaccaagagcaagtcatgcagattgctggtgcattagctagttattctcttggagaaggtgatgtattacgacgtgccatggggaagaaagacttccaacagatggagcaggagcgcgaaaagttctgtaaacgcgcctgcaataacggcatagatcctgagttagcgactgtcatctttgataagatggaaaaatttgctgcctacggctttaacaaatctcatgctgctgcctatggcttgattacttatacaacggcgtatctcaaagcaaattatcctaaagagtggcttgcggccttacttacctgtgattctgacgatattgagaagataggaaaactgattcgagaagctcagagtatgggcattccgattcttcctcctcatatcaatgtctctagcaatcactttgtagctactgatgaaggcatacgctttgcgatgggagctattaaagggattgggcgtggtttaattgagagcattgtagaagagagagatcatcatggtccttatgagagcatccgcgactttatccagaggtctgatttaaaaaaagtttcgaaaaaaagtatagaaagtttaatcgatgcgggttgttttgattgctttgattctaaccgagatttgctgttagcctctgtagagcccctctatgaagctattgccaaagacaagaaagaggctgcatctggtgtgatgacgttctttactttaggagctatggatcgaaaaaatgaagtccccatttgtcttcctaaagacattccgactcgctctaagaaagaacttttaaaaaaagaaaaagagctcttagggatttaccttacagagcaccctatggataccgtgcgagatcatctttctcgtctttctgtagttcttgctggagaatttgaaaatctcccgcatggttctgtagtccgcaccgtgtttattattgataaagtaacgactaaaatttcatcaaaagcgcaaaagaagtttgctgtccttcgtgttagtgatggcatcgattcttatgaactgccgatctggccagatatgtatgaagaacaacaagaacttctagaagaagatcgtcttatctatgctattcttgttttagataagcgcagtgattctctacgtatttcttgtcgctggatgaaagatctttctattgttaatgaaaacatcatttatgagtgtgatcaagcttttgatagaataaaaaatcaggtgcaaaaaatgtcatttacaatgtcaacctctggcaaagaaactaaagctaaagggaataagcctaatgagaatgggcatacacaagctttagctcctgtgactctatctttagatctcaatgaactccgtcatagtcatctatgtatcttaaagaagattgtgcaaaagcaccctggctcacggacattagttttagtttttactcaagataacgaaagagttgcctcgatgtctcctgacgacgcgtatttcgtttgtgaagatattgaagaactccgtcaagaacttgtgactgcagaccttcctgtgcgtgtaattactgtttgagattttctagacgctaggttgcatgcttgaagttctcaaagacatgagggcatgcctatctatctatagatcttgaaaagattttcccgtgactgcgttgatgtattcaacacggacactattatctgcagaaactagggagatcttatagacaggtacatagaccatcgagctacgtacaattaaaaaattatctccaaagatcatcttcactaaatgacgcacacgatcttcggaatactgcgcagggaacacggctgcgtgacgtggtttttgcaaccacacaggattgttattgagtgttgttgtacaccctcggataggctggaactgttggaagtgcgttcctatttgattcccggaggcaaagatcagttttttcttctgacattccttaattactcgctctgcacggatattctttagggctaaggcttgggctaaggattcccgggatgtggttccccctaaggtagctagcgtttgtatcacccgcatatcttgcttaccagcgtgcaaaaggaggcactctcgaaatcccttagagcatgtccaagtccctgtatgcaataccatctcaccattaactaagctccaaaggatttctccctcttggctgataatatgctttttgacaggttcttctttagagaagcgtacgtgcataagggtatgtgggatgaaggcgagctctacaaaagacttgccatcacgatattctgggaacaatgccaacgcctgttctggagagacgtgacgttcaaaaacttgtaactcttcaaatcctgagatttttcgtacaaagcggcagctcttagaaaatacttctgagctatggtcagcagcaagccgcataattttttgtgcacaaggaactcgatcccacaaaaaaacaccacaaaaaagagaagcaacaaaagcagcaaaatatagaattaacttcttcataaagtaccttttttgtattttacacaataaagaaatgttttatcaaataaaaaaataacaagttataaataaaacaaaaacaaggcatttgacaaattctgtttttcttttttatgatggcgttttgttgttgtaagcccccgtctaattatgaaatttctattatacgttccacttcttcttgttctcgtatctacggggtgcgatgcaaaacctgtttcttttgagcccttttcaggaaagctttccacccagcgttttgagcctcagcactctgctgaagaatatttttctcagggacaggaattcttaaaaaaaggaaatttcagaaaagctttactatgctttggaatcattacgcatcacttccctagggacatcttgcgtaatcaagcacagtatcttataggagtctgttacttcacgcaggatcacccagatttagcagacaaggcatttgcatcttacttacaacttcctgatgcggagtactctgaagagttgttccagatgaaatatgcgattgctcaaagatttgctcaagggaagcgtaaacggatttgtcgattagagggcttcccaaaactaatgaatgctgatgaagatgcgctacgcatttatgacgagattctaacagcgtttcctagtaaagacttaggagctcaggccctctatagtaaagctgcgttacttattgtaaaaaacgatcttacagaagccaccaaaaccttaaaaaaactcacgttacaatttcctctacatattttatcttcagaggcctttgtacgtttatcggaaatctatttacagcaagctaagaaagagcctcacaatcttcaatatcttcattttgcaaagcttaatgaagaggcaatgaaaaagcagcatcctaaccatcctctgaatgaggttgtttctgctaatgttggagctatgcgggaacattatgctcgaggtttgtatgccacaggtcgtttctatgagaagaagaaaaaagccgaggctgcgaatatctattaccgcactgcgattacaaactacccagacactttattagtggctaaatgtcaaaagcgtctagatagaatatctaagcatacttcctaagatagaaatcaatatgagattgttttctttaggcacgatttatctttttttttctctagcactttcgtcatgctgtggttactctattttaaacagcccgtatcacttatcgtctttaggtaagtctttattacaggaaagaattttcattgctcccataaaagaagatcctcatggtcagctctgctcagctctaacttatgagcttagtaagcgttcttttgctatctctggaaggagttcttgcgcaggctatactcttaaagtagagcttctgaatggtattgacaagaatataggttttacgtatgccccaaataaactcggagataagactcacaggcattttatagtctctaatgaaggcagactatcactatctgcaaaagtacagcttatcaataatgacactcaagaagtccttatagaccaatgtgttgctcgagagtctgtagactttgactttgagcctgacttaggaacagcaaacgctcatgaatttgctttaggccaatttgaaatgcatagtgaagccataaaaagtgctcgccgtatactatctatacgcctagccgagacgattgctcaacaggtatactatgaccttttttgaaggagaaaccgtttttcctgcagtacttagtgaacttcatagcatgttggacttaatcaaacgtgcaggaaaacaatctaagtgcccccaagagaagttgttaaagctcgagcttgcttgtgaggagcttctcgtcaatatcatttcttatgcttatcagggcgaaaattctccaggaacgattgcgatttcttgcatctcccatagaggagacttagaagttgtgattaaagaccatggaccttctttcaatcctcttgctgtttcaatcaacattcaggaagatcttcccttagaacagcgtaaactcgggggcttagggatttttctggctaaaagttctgtggacgagtttctttatgctcgtgaagatcattgcaatattgtgcatttaaaaatgctcaatggccaacattcctaaacctagtgatcgttattaaagcggaaagaacgcagagcattttcagtatctttaatatccttaagatataactgcagggcttcgagaatcagcgacgactgattgtattgtccagaggcttcgaaagccatttctggttcatagtttccttctccttgggaaaccgcaatatatccccgagtgactgcctgtccttgaacaagctcaggaacgagccaaatagcaaaatcagcgttaaataatgtgagtttatctttagattctgcaataataaaatcgttgtcagactggctacagagaaagtcagtgttagcatcagtgcaatgaggataagagagtatttctgcaatatttaagtatccttcggggaaggacgtccctgtattgagtattgactgatgatagaactcctcgaaaaaatctaaactcatagtatatttcctctgatttatggtaattctttattttcagagccgtcaagtcctttctattctgttgaatttcctaataacgtaagtaataaacaatcaaaagtccgcatatgaaaagacctttttttacctatctatgcatcatcttctacggatcttgtgcatcgttatctttacatgcaggactctctttcccagaagtacgtggagctacggctgctgttgtccatgccgactctgggaaggtattctatgataaagacatagatgctgtaatctatcctgccagcatgacgaaaatcgcaactgccctctttatcctaaagcactatcccacagtcctcgatactctcatcaaagtcaaacaagatgcgatcgcttccatcactccgcaagcaaaaaaacaatcaggatatcgtagtcctccccactggttagaaactgatggatctacaatacagctccatcttcgagaagagcttttagggtgggacctgttccacgccttactggtctgttctgctaatgatgctgcgaatgtcttagctatggcatgttgcggatctgtagagaagtttatggataagctgaacttcttcttaaaagaagaaatcggctgcactcatacccattttaataatccccatgggttacatcatccgaatcactatactacaacccgtgatcttattagcatcatgcgttgcgctctgaaagaacctccatttcgaggggtcatctccacgacaagctataaaataggggctacaaacctgcatggcgaacggatcctatccccaacaaacaaattgcttcttcctgggtctacctaccactatcccccagctttaggagggaaaacagggaccaccaagactgcagggaaaaatctaattatggctgctgaaaaaaataaccgcctcttggtaacgatcgcaacgggctattcgggtcctgtgagtgatctctaccaagatgtcattgctctatgtgaaacggtatttaacgagccgctattaagaaaagagctcgtccccccctccgactgtctccaattagaaatagcgaatcttgggaagctttcttgccctcttcctgagggactctactatgacttctatgcctccgaagatcgcgaacctctttctgtatcttttattgcacatgcggacgccttccctattgaacaaggagatcttcttggtcattgggttttttatgacgatgaaggcaagaaaatttcttcccagcctttctatgccccttgtcgttttgagcgcactatcaagccttggaaactctatatgaaacgtgtcttcacatcgtatagaacctatatgtctataaccatgctgctcatgtattttcgcatccgcaagcaccgcaagtataaaaatttaaaacactattctaaaatctaactttttcttttaatttataaaaaaccaaaggtttatgtaagatttgcgcttttcaatccaacaagaatcccttgtgcgcacattactttgctgtttacttgtcttcacttgtacttcttcaagttatgctcagatatcctttcctaaaaaggattctctcctctcttttttattgtcttggaactcttagggaaaatctacagaaggaaaagcataccactgtttccttaagcaagtgtctattgccttaaaccgagaagaagtttgggataatccccatcacttaatgtttatcttaatgcaattccaacaattttcaggggaacaggatcgttttggaagtttcttagaagcaaccatccgtgatcgggtctcttttttagtcttacaagaaaagattgccactttaaagtagcagtttaaaactctgcataccaaagatagagcttcttatcgttactttagggaacggtaatgtttgatttcttttgaaagattcgggcgctctacagcgcctctattctagattttttgaaaatgagaagtaaaaaatgcgtcgcccttacctacttgtaagggaagcgtttttctgtggacttctttccaacctaaagagtgcatgtaggcaacatgagcctcattttcttcttttaaaagagaacaggtaatgtagacaagtcgtccccgaggtcccacataagcacttgcttgttttaagatgctcttttgcactcgcacatagttcaacaacaatttcttagaaaattgccacttatgttcgggatgtcgtcggaaaactcccgttccagaacaaggagcgtctacgataactacagaaaaggatcctaaacgtaattgatccgctaaagaaaaattcctagctccagcacgtaataaacgatgctttgcagtttgcaaaatagctttacgactgtcattgatcacaacatgttttgctttctgcgcaaagataaggcttttcccgcctgctcctgcacaaaaatccaagacgatatctttatctgttagggaaatgccctgagaaattctctgagagttttcatcttggatttcgaaaaacccacgacgaaatgcttctgtagattgtaagggatgacgtttggaaaagtgcaatgcctcaggaagctctccaggagaacttggatattctaacttctcttggagttctttgacggagattttatctgtattcacacgaatcgtaatcggagcttccgttaaccaaatcttggcgatctcctcggcctgttcttctccataatcttgaactaagaagtgcgcaagatcatcagatatagagtaacgcacaggccagggaatagcgctgtaactgtccaagttctctagaaccccttcgtttactttcgcaacgagagcttctggagttacttgttctcccgaatcaagaattaaagtttcaagaagacggcgatgacgcaaaatattaaaaataatattttgaatccactgacgatccttagaccccaaagaacggttttgtttaaaatagtacgaaactctatctgcttctgaaattgcagacgtgtgtagctgttttaacagctgataagcatgatgctgacgaaaaggaaccatagtgacatagagtatacctcgtcatcacctattttgcttggaaaatcttacagaagacaaaataaagagagccatcagtatagtaaaaaatatgcattacggacgacgttgccataatctcaagaattgtctccaaaaagaaggatgcggattatagtattccgctgcttttcttaaggctataccgatatctctatcatagtctaacaaccaacgcataagtaacatggtaatcattttatcccacagggcgggattttggtctcgaatactataaatattccccacctcctcaggagtggtattgtcggacttagatacatggagtttcttttctacgatgactttccgcaatacttctgcaagaaagcccagggctaatttagaatcttcaggggaggctagggcagtctcttgccatagacctacaaaagtcttcccatgaaatgttaaaggctggttcccaataagagagtttgccaatacctcagatagagaatctgagataatactcataataatcgtttggaaatcctcggcactcaaagaaaaaagctggatcagctcgcgtaacaatacgtagctcttttctgataatgtttttaggggttgcgctttttctcctataaactggttgagcaattctaaacttaagggaagatacgccgtatgcccttcaagtaatgtggttaacgcttctatgatcatttgtagagaggcatctgctgccaatcttctttgcacctctccagccagaggcgtctgaacttctgataccgtaacctcatgagtaaaatcttcccatgaggaaaaattacttttccctttagagaacaccttatttgcagcttgcacaattttatcgacaggacgcttggactcaaaaagaatcaaagacttaaacatacatagtttgtctacaatggcttttttgatgtgatacttggaggggaagaacagccggtagagccatcctgtttggggtttttcttcatgcaaacgcaattcaataattgctaaaagtcgactcgatatcgaataagaaattgctgaccaggaaaagagctcgtgaattacctgacgaatcgtggatacgcttgtatcatagttggtaggtaaggggtcattgaccggccatgcatctaagagaagtcgttttctgtcatatgcgagtatgcgcgtgccatccctaattgctagttcaagaacccgtaaataatatcctatagaaaattgaaaatctaaaatcatagatagtggtacttagagcttttctatgttttattcttcaggagaaatattatttcatcatatttatttcctgaagttactataggcaatcgttaacaatgagaacttttattaaaaagtcctgaatactagtctttgggctctattgatgtcagacgctcgctacagaaaaactgacagatcacatagtttaatttcttctgatatgctaggggatgcgagcgatagtcttcttctaagatagggagatttacttctaagatagcgagaacgacatcatagtttacttctgaggcgtgctcttctgaccacatcattaaaaagtctccgagctctttgctacgatcttgacgtactaaatagaggatgtctttcataacgagagcttcgttctctcctttatcggcaaactcatcaatttgggaggcacaggcaagtacctgagtatagttacgaccaagatcatatgtttttaggttgtcaacaacgctgacgcattgcccagctcctaaataaggagaggtaattatcttagtaatcccacggacgttagctaacccatcaatacgtttgtctgagtataatagttcggagagccttttggagacttcttctactgttgttgtagcttctaaagaaaacgcattatacattcctgcctcttcgatgacttctaaaggcagtccttcttgaactgcgtccgtagctacccacttgcagcaagaacgtaagattaaagcaaatgcaactgcagcttctggacttataggatctgtaccacaaaggtctaaaggagcctctgggtgttgacgacgtaaaagagtgaatagccttaaaaatacatgaaagaaaaagcttcggcatgaagctagtgctgtttctaaagcataaaagtatggaggttccgcagtttctttagggagtcgcgttgctttgagaagatcacaagggatgtcccccaaggaacgcactccctgttcttttggatggcgttttgttttaacatgcatccaaatctgcgatactgctttacgaatccgcgcaagcatcgtagttaacaggcttccgcgagcttcatattctactctatctacaaggtcgctatttaaatcactattcgtaccttcagatggagttgcttctgggatccccgtatccgctatggtttctatcacttgggtagcactttccgatacccgatcctctaaatctgaatccccctcttctgcggcactttcttctaaaggatctgatatcgtattacggtcaccatcattgccagatataggagttcccatcgattaactactccacaacaatgcttctgccttttttattcaaaaagatccccgattaaaactgtcattgtattcgcccaagctccgaccgataacactttcataccttgaagtagtctactcgactcattggccattcgcacaacgtcacgagtgtgattctttcctgcatttgcgattcggacggaagtagcatgagagtgtacagccgcaccgagttctcgtgctaatgctatccatattctaggcatctcattaggatgattttcgcgtacccgatctaaagctgaccctaatcgagctatatcacttgtataatctatgtcgctatcatctccaccgaaatccgaaaccctagtttctaaaaagttttggatagattctcctgggtctaatgtaggtccttcgatacctaagcttataaccacttgcatgagtacaccatcaggatcattacctggcttaggattttctaaattcttaattgcgcctctaactgtctgagttacagcatccttagctacagtcactgcttgcggaactggtcctgtagatgaagtcccttcgataagcatagattgttctgtgtatgtttgctgcaaagctcgagcaatgacacgataaccatgcaaaagatagtctggacccctattattttcccaatccgtccactttgtttgtagctcttgagatacctttttaagtactttttgagactccgcatgactatggactgcatcttttaattcactcacaagtttagcgacttcagaactcatggcagtaggttgctctgatcctgaagaagaccccgccgtaggaggttgaggtgctcgacctttcccatgcgttgcgggacgtttcgcattagccccacccgttgtaggaggtggaggtgccggacgcgtaggccgtattgtaggtcctgaaggactttgcattgcaggtcccgaagcaccctgagaagaatcgggtgatttcttccctaaaaagaactcccttaccgtctgccataactgctttgctttagaagcaacttgcggctgtgaggttgatgtagttacgttgtgagcaccaagatttgagtttgtagctcctgtaccttgggtactggagctatcgccttgagctcctctaacccatacatcatctggtgatctattacccgaaggattgattcccattgcaattctctatttatttttcttttttaaatttaattaattttaaaaagaaaataattatgtataaacttttttaaattaattaataattaactattacaaaaaccactaaactataaagatcgcttactaagacgtagaatgtgcgtactacctctgtaagttccgtaatacccaagcccaatagagagaaagcaccccgccaatctcttagagagacaggcctgagtggttctcttgttcaccgccttttaaaggaaaaccttagtggctacatttaatcttcgtcagaccagctgacacgcttctttcctgaagtcccagactgcccaggctgtttcaaaatgcccttaggaggttgaggtgctggacctttcccatgcgttgctgcgcgcttagcattggtcccacctgttttaggaggctggggtgctggacccttcccgtgcgttgccggacgttttgcattagttccacccgttttaggaggtgggggtgccggacgcgtaggctttagtgtcgtgctacctgatgaacgttgggcccctcctccaggaacctgtgggatagtgactttcatccctggttggtacccttttttaattaagttcctaccagctccctcggtagcgcgagcatcccctcccggcaacgggctacgtacagtatctgcagatggagcagagggttgttggctacctcttggagctcccgatctgaagaagctcatccgactaaaaaacccggttactgcttctttgattcgtgctaataacccttggcgtcctcctgaggcagtcactctatgacttcctaggttagcacttgtaaccccggattctttaacatcgggatgctgatcatgagctcccgtaatccagagatcgttcttggaatttcctgatggattaacagacattataattttctatttttatttttctttattacttaattttaagaattaaattaatttatctataaacattttaaataaaattaattcgcaattagaaaatataactattctatttctaagagaaaaaagacgtttttataataaaaaacatctaaagttcagggagttatctccagaggagtcctctggtgaaaatttgaaaaatcggaatgtattaaggtttggagaattacaacctaaagatagaccaaagcctgggggaaagagttacccacacatagacaagcaccgcagctctccatgttaagagagaagaagagcgcgatgcatcgtgtttacctaaacgacaacaagatacatctcttaacacgaattcttaagtatgttgatttaagagtactttagcttttggatggagataaaacttctgtacctgggaggaagccctgctctagaaactctaaagaagcccctcctccagtagaaacatgggaaacttttgtagagcagcctgccaaagcaaccacagctgccgcatctcctccacccacgacagtaacagctgaagggtgattgcctaaggcattcgctatagcaatagatccagagtcaaaaggagggacctcataaacacccacaggaccattccaaaacacagtcgctgattggtttataatacggataaattcttcggttgttctaggtccaatatcaaagccttgaagatgcggaggaatgccttgatctatagaaatcacagaatattccttagattggagattttcggctgctttcacatcgctaggcaaaactatggtaacattacgacttttagcaattttcaatacatttctagcaagatccaaggcagatttctccacaagagagttccctagggattttcccaaggcttgtaggaaagtaaatcccatacctccagctaataagaggtagtctacttgattcagtagagcctctataactccaattttagaagaaatcttagctcctccaaggatggcagtgaaaggcctcttaggggaggtcaatagatgtcttcctaaaaattccaattctttttccataagcaggcctgctgcggctctacctgggaaagcctgcggcactacatagactgaagcatgttttctatgcgaagttccgaaagcatcgttgacatagaaatccccgtaggaagagagttctgcggcgaacgtcgggtctttttctggatgttcttctcctatatggaaacgcaagttctcaagaagcaaaacgcgaccaggagaaagctgagctacagcttgacgtgcaacctcacccacacaatctggagctagaggcacatgatgtcctaagtatccttcgagaacatccacaacgggttgcagagaatattcctcttggaacccctgtcctttaggtcgccctaaatgactcattaaaatcactgcagcatgtttcttaagtagatagttgattgtaggcatcgcactgcgaatacgaatgtcatcgagtatcttgccatcttgcatggggacattgaaatctacacgtacgaggacttttttttcttctggagaaagatcttgtactgttagcttatccatatatcctcaagaacctactatttgatttttcttatttttaatggaacaaagctcttaaagcaaagaaaaagagtatggataataaagctcctgcaggaagcgtaataaaccaggagagtacaatatctttgataatgtttaagttaatggcacggatccctcgtgctaaacctattcctaaaacagctccaacaacaacatgtgtcgtagatataggaagtcctaaaatagaagctaaagcaattgttaatgctgagcccatccccacggaaaaccctcgagacggggttaactcggtaattttacagcctacagtttctataacacgccatccccaaatcgcaaggcctatgaccaagcctatgcctccaaatgccatgagcctaattaatgtatacgacgtataggaagcaggatatgcctgacgcaagactccagctacaggagcaatggcattagcaacatcattagatccgtgagcaaacgccataaagcaagctacgataatctgtaggtaggcaaagattctttctacaacaagatactttcttccataatttccgcctcgttctttcaaacgataggtaagactgcctttttttggtgtatctgaaatgtaggaacagtgcttggtatggacgtagtaaaacgtaatgatataacttagaagtccacaaaccagaaccccactaactgcccagggagttgaagaaaccttaaggatcacgcccccagagatcatcacggttcctaaagtcatgatcaccaaagctgctaaaaacggagcaacacgaaccatagcaagaacaggatcattcttataaaaaatatggcgccgaatgaaagaaaagatcaggtaagcaacacacccacccataaaaggggagagaatccagctaattaaaataatgcctacggaattccagtaaatgattgttcccttaccaaggaccaatccaaagccaatcacagctccaactatagaatgcgttgttgagacgggccaaccaaaaaaagaggccagctgcaaccacacgcctgttgctagtaaggctgccgtcatgccgtacatatagtccccagaggcaatcataggattggtcacagaaacgatactactttctatagtccctgcaacacgatctccaagaaggagagcaccaaaaaactcaaagatagcagcgatgaccacggcttgtcgcaatgtcaataccccagatcctacactagggcctacagcattagcgacatcattagctcctatattccaagaagtataaaagccacatagaaggacaaaaatgattaatggaagcatggagtattacttttcttctagggtcatattaattctatgtgcgagcttttcagaactatctgaaatccccgcagtgcgtcgaattacttgtaaccaaagataaaactctttttcaggaattataaaatcatcagaaaaaaatatttgcataagttctcgttgcaaaacatccgattcatgttcagatttagccacacgccctacaagcaagcgtgctttatctgccttcctccccccaaatgaactttcaagcaattggttgaattcatgtagcaatgtcatagttaactcaaaagcttctagatttttttccaaaaatcggaaaaaaagcgtttccatagatggataaaagtttaatcgtctgatggttaataagatagcaacatcttcagcagtatccgcgatgctatcttgtatagaaataatttctagaatccccgctcgagatatcggcatgaataatcctgcaggaagatgattcctcatatcattttttatacaatctgcttgatactctttatcagaaacaagttttgccatttctaataattcttcatatcttccatctcggagagcagtgaatataggaagcatgtattccacacaagagaccaccatttccagatgagcttgtaaaggagcaaatggagattggccaaatagacgagcaagggtttgcataagaatagcctttttcgcaataataacttgcctaaacgatcttgtaaacgacttatggcttctaatcccattttacagatagaggatctatccataaccttggcaaaacaacgccaacagtaccccatcgtccaatctttatcgtttactatcaatgaaggacaaaccttagcaatcattggagaatcaggatcaggaaaatctgtctctgcgcatgcaatccttcgattacttccttgccccccattttctgtttctggccaggtcaacttccaaggccacaacttacttacggcttcgcgctctatacaaaaaaagattatagggacagaaatttctatgatctttcaaaacccgcaagcatctctaaaccccgtgtttactattgaacagcagtttcgagaaattattcatacccacctagccttaactgcagaagttgctaaagaaaagatgttatacgctcttgaagaaacagggtttcatgatcccaggctgtgcttgaatctctacccccaccaactctctggagggatgcttcaaagaatttgcattgccatggcgctcctctgttctcctaaacttcttattgctgatgaacctacgactgctttagatgtttctgttcagtatcagattctacaattactaaaaacactacagaaaaaaacgggaatgagccttcttattattacccataatatgggagtcgttgcagaaactgctgatgacgtgctcgtgctctatgcaggacgcatggtagaatgtgcccctgcggttcaaatgttccataatccttctcatccctatacccgagatcttttagcatccagaccctctctacaaccgcaacaactaggttccttcaaccccattccaggacagcccccacactacacggcctttccctcgggatgtcgctatcaccctagatgctcaaaaattttaaatcgatgttctgcggaagctccagaaatctatccggtacgcgaaggtcacaaagtaaggtgttggctgtatgacgactaattttccccaacctttaattcaagcaacctcattaacaaagcactattacaagcgttccttttggtttcagggaaagacaattgccagtcgtcctgttgacgacgtctctttttcactatactccagacgtgctgtcggacttattggagaatctggatcagggaaaagtaccctggcgttagctctcgcaggtctcctacctctcacctctgggttcttaacttttaacggcaccccaatcaagttgcattctaaacacggacgccatcaattacgatctcaagtacggttggtctttcaaaatccacaagcttcattaaacccgcgaaaaactatcctagatagtttaggccactctctgctttaccataaactcgtcccaaaagaaaaagtactagcaacggtaagggaatatttagaattggtagggttatctgaggagtatttttatcgttatcctcaccagctttctggaggacaacaacaacgagtctctatagcgagagccctattaggagtccctcagttaattatttgtgacgaaattgtttctgctctagatttatctattcaagcacaaattctgaatatgcttgccgagctgcaaaaaaaactcagcctcacatatctcttcatttcgcatgatcttgccgttgtacgctcgttctgcacagaggtattcattatgtataaggggcaaattgtagaaaaaggaaatacaaaacgcattttttctgatccacaacatccttatacgcgcatgttgttaaatgcccaacttccagagactcctgatcaaaggcaatctaaacctatattccaagaatatcacaaagattctgaagaatcttgctctacaggatgctacttttacaatcgttgtccacaaaaacaagaagcttgcaagtcagagatcatcccaaatcaaggagacgcgcaccatacataccgttgtatccattgattcgtcctctacgctattcttaagctaccattaaggaatcccaagggagaggtctgctctatatatcctgagtgatgtttgactttatgttagctagagcattccgagctgcaaacacaattgtaaatacaaaacaaaagccattccatatccatggaatggctactttaagacctaacgcaacatccattcttaatataaaagaagacgctcttagcctaggcaccgtgggatctttcgcaagtaccgctagtattaagatagactctcactgagtgtcccatggctggaaagccaagcttccaacttttgaagatcctgagtattttgcaaatgaaaagagactgtagcctttgatccccgggtttttatctggaccttatacccacaaagatcactgagacgttgttgcaattcttcatgctgctttgacgactctgccatgtctaaaggagtgggcttcaactctatcgaagagccctcttcacttataagctgcttcgctatcagttccgcttcacgtactgccaaatgctcttgtatgatgatctcattcagcttttccctaagtataggatcttccagagtcaagatgactttagcatggccgagagtaatctgaccctgcaacaagctttcctggatcgtcttagaaagagcaagtaaccgcaaataatttgctactgtagaacgttttttccctactttataagcaactttgtcctgagtgagtccaaagacatgaattaatcttttaaaggcctcagccatttctatagggtttaaatttaccctttggatgttctcaatcaatgtagcttctgcagcagtaccatcagcaatgacatgcttgagaatcacaggtatcgtagttgctcctgcgagctgcatggcccgccagcggcgctcgccagcaataagctcataatataacacccgatctccagtgcaaatttcacgcactacaggaggatgaatcaaacctacagcttttatcgacgctattaattcttgcagctcctcattagagaatactcgacgaggctgaaaaggactcacacgaatatcatctatagctacttctataattgtatccttactgatttcctcagtcacaatatctcctgatttttcctaatagaattttggatttgcaagcatttgaaatcctggacgtacagggaatgcttacagatcaacgtaagcatatccaaatgctgcataaacataacagcattgaaatttttctatcaaacatggttgtagaagtgaagctcttttttaaaacccttaagtaaaaatctgggcttttctatcgggaagtttaggtgctgtaacgacgggtagagcttcctaggtcttctttgctcgcagacataaacagacgaaaagaaaaataactcttgataaacacgaaacaacctccccccacgcatcatcgagtctttagcttatgttctggaaaagagaaaaaaattgaatgcgaatgctaaattgcgataacataaagtgaaagcttcaaatcaaaataggtttaagccataaaactccaaacggaagagcacaaactctagttagaggaagatccataaaaatcttcggcatgcttatagattttcaacgccaaactgtcgttcctttatgcaaaagctagtccataatatttggaaaaaattttattctttttcttcggcaattgccatttgtatcgttcttgcgtccttcctatccctaaagattgtttctaacacgtataaacattcccaagccaaacgtaatagcattcttctacttacgagagcagctgaagtcgctgtttctcaaggattccttccatctaaatctgccttgtcgtcattggaacaagcctatcatcttggaggagaatccatgaagccctatgcagggtttttagcttcgtgcttctatattcataatgagcctttacgtggagcctactacgcaggactcgcttataacaatagtcaagcactgcagctgccccaccccattcaaaaactcctcaaggaaatttcagaagcacaagctgatcaattgtatgatgttgctttaagtaaatcctatcagctcttacaaactgctaacagctctcctgaatatcctactctatcttttttaaccctactacgtgtgatcgaactcaaagaactcctccaccaagatgtaagtcaagactttgcagcattgaaaagctcccccctatttcaccaatttgaacgcatgtatagcgatggagaatggacattaagcaaacgttttggcaaaaaaggataaaactcttaaggacctctatgtcagaatctctagaaatcccggaacttactgaagtgctttctgagcagccgtctctttctactcccgactctccccctaaagtaatcacagggaccttaaccctatacttccaagaagatattgaccctgcttcttaaagccttatgctcatagttcttgctttccgacaggtctttttttcccactctcgttcccagttagaccgtctaaaaaattacctacggctcctaaaacaaaactttgctattaccctccccaaagaacgaacctcaaaaggacattcgctaatgctcacttttgacttcgcctcctttgacttctatacaaatatctttcccttccttgaggaacaaaagattcctgctgttgtaggggtagcttcccgatatattccatcaaatgctgctcaagaccttcacccttcacatcgtttaaaaccctctgaaactctagcattccaagacgagatcttctctaactacatgcccttttgttgccaaaatgaactgatagaaatggcaaagtctccctatatccaattagcatcctcaggattcgcaattcggaatctcatgaataatcctccgtatctcactacagaaattttactttcgcgacatcacatagaaacaataacaggagccaagcccttggcattcctcttccccttcgggaagtcagatcctacaagccggaagcttgctgcagatcactacccctattctttcctgttagggaataccattaacagaaaattaaaaactcataacatctaccgcttagacataaaacctatgcagtacgtctgcccgagtttatttcagagctctaggtatttaaaaaactggattaaagagaaaagtaaacagctgtatctcaaaaaacaacttccaaaaagataaccttaccacgtccaaaaaaatagaagatcctatcgcagacgggtcatctacgaatcttatctaaagaatcctgcaaaacaaggatgaattgatcgatatcatcctcatcattatagattcctaaggacactctcaacacatgacccacattccatcgctccatagcaggttgggcacattgatgacccgtccgcacagcaattcctctaagatctaataaaaaacctagatccaaaggatgggctccatcgattgtcatgcctataagagctcccctgggttcctctatagaaggtccgagaatctctacacctggaatctcaagcagctctttatgtaaatatgtagttagggcaatctctttgtcgtagataaacttagctgacaagccatcgagataatctaaagcagcccctaagcctaaaactccagcaatatttggagtcccagcttcaaatttcataggtgcaggaagatattcaggattctgatgatcgtagatagcaaccatatcaccacctccttctactggaggcaactgatctaatagatcttttttcccatataagactcctatgcccgtgggtccataaatcttatgtgacgaaaacacatagaaatctacatcccaaagctgaacgtctataggaagatgaggagctccctgagcaccatcaacagcaaggtaagcgtcatagcggtggacaagctcagcaacttgttggagaggttggacacaacccgtaacattactcacatgaggaatgcttacaaattgagcaccttcatttagaagcttttccaaatcatcaagatctataagccctgaatcatgaactctgatcttttttactaaagaacctcgccgccgacaggcaatctcccaagataaaacattcgcatggtgttctgcctcagaaaccagaacaacaccccccttagggatccagaggtcattaacagaaatggctaataaatttaaccctgcagttgtcccacgggtgaatacgatttcactatcagaggctgcggatacccacttacgcactttttcgcgaacagctgcgtatgcttccgtgacgttcctagaggaactataaatcgcacgatttacagttgcatatgaagaagtataaaagttagcaacggcatctatcacctgttgaggtttctgagtcgttgcagctgaatctaaataaataaaaggctcgttctcttttgctttagcagcaaaaatcggaaaatcttcttttaaattcttcactgatcatccccccccctaaatcctaaacctaggaggtttgatttagctgaaaagaagatcccaaaaacgtatcggaaactaatccttgttttaggaacccatgtatgagtttttcctgagcctctgcctctgtcatgcctcgagaacgcatgtaaaagatctgctgaggatctaaaggtcctactgtagcgccgtgggatgccttcacctcgtctgtttctatctctaaacgtggaaatgtagatacacgagcttctgaacttaataacaacgtatcatgcttttgattcgcatccgacaagtctccttgagaagaaatagaaattgtcccttcaaatagaaaatgccctgaatataaaatcgatttaatattctgacgcgataccgtctcttcagcatcgtgagacattaaattattgacccaagtttttcttggcgattggactaacactagagattctgcgtgtcccttcttcccgactatgtagctcgtattgtcaaaccatccgaaaccttgacaactttcaagcaaattctgagtcatcctgcagatagcatctttctcaaccgtcgcaatagtggaccaactcaaggtatcctcttcagaatatcctggaaccataaacactgtaagatccgccccttctccaacgaagagctcggtaaccccattgactatagttttactagaacccaccatctctaaatcaacatcatgtgatatttgtatttgagcggacgcccgttgtcctaaaataacgacgatcctaggagagaaaatcacatcatgatccgaaactgtaggaaaactaatatgacgtacaaaaataggatcgctcgtctgcatctcttcaggaatgtaaatcactacaccccgatcttcagaacaaacagcatttaaaaatgctaagggatgcttatttacatcaaacccttgcatgaatgaagacaatgatcccctagcttcgtctataccacagacaatcaccccctcaggcaactgggataacgaaggttcgtattttccattaattaaaatacactcaaaggctaaagaatggttattgtgtagccaatgttgcttaattagttctgaagctccagtcgcaagattatagcgatcaggaaaaagagaaagctcctgaatccaagaaaagctactaagcacctcttttgaagaaggctgcttgctatattgagtgtagcaagcttccgcagctttttgcacaggagaacccgaagcaatagaagaaaatgtctctattgaaactaacaccttatctccacgcaacacgcttagtcacctcttggtagctttttgcttctaattcatgcatcaaagaaacgtctcctgaaagcgctactcgaccatctaataaaagatgaacaacatcagggcgaatgaggtttcctaatttggggttgtgagtcacaatgcataaggaactggtaggatgtaactctcggtatttctccaagactctacaaatcaaacgtaatgcatctacatccaaaccagaatcaggttcatctagtaagaccatttcgggttctaaaactagcatctggcaaatctcattgcgctttctttctcctccagaaaaaccctcgttgacattcctatctaaaaatagatctgtagtcgcgttatactcatatgtctctaatacagtcgaaagcagagtattaaactcatcaatagaaatatctccctcttgattcgcacgacggcgggcattataggcgtctcgcaaaaacatcttgttattgactccaggaatctctggaggcatttgaaaaccaacaaatagccctgctcgggaacgctcttctggcaacatagaaagcaaattttgctcctgtaatgcaatctcacccgaagataccaagacactctcatctcccgctaaaattttagcaagagtcgattttcctgccccattaggtcccataatgacatgcatagttccaggttggatattcaaattgaaatcatccagaatcttcacatcattacagctagcatgtaagtgctttatttttaacattgaacctaacccacgctattttctaatttaattaacaataacttcgatgcttcctgagcaaattctaaaggtaattgttctataatttcccgacaaaaaccatggatcactaagctgactgcttcctcaggactcagtccacgactacgtaaatacaataactgatcctcacgtaattttgaggtcgtggcttcatgctcaattgaagatgttgaattttctactacaatcttcggatccgtataggctccggaagccttgcctatcaacatggagtcgcattgcgtatagttactactatgttcagcctttttccctaaggagaccaaacttctaaacgtgttcttagactcgtcagaagaaattcccttagagatcaccgtggatgtggtgcgtttccctacgtgtagcattttggtgcctgtgtcggcctgcattttcccactagtaagagctacagaataaaattctccaacactctcgtcgccctttaaaatacaactagggtatttccatgtaattgcagcaccaacctcaacctgtgaccaggagatcttagaacgatagcctgcgcacagacctcgttttgttacaaaattataaatgccgcctttccctgttttcttatcaccagcataccaattttgcaccgtggaataccttatgaccgcatgctcatgagccaccaattcaacaaccgcagcatgtagctgattagaagagtatgccggcgccgtacacccctcaagataactcgcatagccgccatcctccacaacaatgagagtacgctcaaattgacccgcttccttgttattaatccgaaaataggtagaaatatccataggacatttcacccctttaggaacataaacaaaagagccgtcactaaaaacagccgcattcaaagcagcaaagaaattatcccgatgcgaaacaacggagcctaaatatttttttaccaaattcggatgttcttgaatcgcttcgcccaaagaacagaaaataactccggccttttccaacgcttctttaaatgtggttccaatagagaccgagtcaaaaactaaatctacagcaacattctcgacatttagtaagcgcttctgctcatctaaaggtatacctaattttttgaacgtatctaaaatttctggatcggcatcttctaaacgtccaagaggttttttctgcttaggagatgaaaaatagactatatcatcataggctataggaccataatgcaggcgtgcccaggctggctcatgcaactgcttccaataacggtatgcttgtaaacgaaaatctataataaactgaggttcattacgtagagcagcgatttcttcgattgtctcttcactaagtcctcgcgtcaatccttgagactctataggagtcacaaaaccgtaaggatagtcctcacgctcttctaaaaaaacctttactgattcgcccataacctttaatcccgtcgcgcaaaactcttgaatttatcgtattaaattacacgaggacaaagctaagatagcacacagattattttttcagtataacaaagaaggcttgaaagacgaacctacccctttcaagcccagaagaaaagagaaagaattttctaaaaatcctaactcccttggagatcacaccatcagcatggaatacactaaggcgcttacatgcaaagccattctagggaaataaaaaatttttgtcttctaatttcaattgaaaacactatttccctagtttattgctgtgacgttttttctacttaacatgccttaagaaatagtatctaaacgcctttcaaattgcattgaggagggatctgacaccacagtcttctgcaataagggagcaaacgtagaatcctttttttgcaaaaataaaagctcttttgttgccttatcggtctctccttgcatatgatgcaaatagcccagaagatagtgagcgcgctcatgttctaaattaatagacaacgcgctattaaaagcctcatacgcttcccgcatttgcttaagatccaagtgagcaagtccgacataaaaatgtgcatcagcatcttcagcattgagaaacaacgcttcttgaaaagccttcaaagctaatcgagttttatctaaagtgagataacataaacctaaattgtaatgaccatcagacaaatcaggtcgcagctgaacaacacgttcataagcctcagtagccttgtcccatcgtttgcttcgagaaagcaaaaaacctaactttacccaagctttccaatataagggattcttcgctacagcaacttcaagcaaacgaatggactccgcttcatcgtccatttcagaaaggatcactgccttattatataaactttgtggattccaaggatcaagtgcaaggatcttatcaaaacaatctaaagcctcttgaagtctcttcaaacgatgatatacacttccaagactaaaccagcactcaacatcatcgggatgcaaagcaacatacgcactatactgttcgatagctgcttcatattgattcccccggtctaacgctacaccataacaataacggagatagctgtctcccggctcggatgctaaacctttagaacaccagttcaaagcctcggagactcttccagtctctaaagcaataatccctaaataacaataagcgagtgctgctgtagagtctaattctaaggtttctttcagtcttttttccgcttgctcatattcaccgctcaaaaaaaggttaattcctgaacacagaaattcttttgccaagtgtttcgcagcttcttccatggatatttctcccagcacatgattcgttgatctcaactaaatgaggagcgaaaaccatgccaaaagaaaactatccccttaaaaaagattctctttgttgaattttttcccacatatcaatcatttttaccgccataggagccgcatctcgaccaaattctcctaagcgtaaatagactatgactacgatcgtaggaagagataaatcttgatcagaaaaacccaccgcagcaaaccagatgtctttcattttcatggtaccatattcccgatccagtcccacacgcataatggactctgctgtacttgtctttccaataatacgagacaaaagttgtggaggaaattgactttgtattgctcgagctgttccgtattgaccccagataacattgcgcatgccagtcttaagcacctctactacagcatcaggcatgaaaatcgttcgcttctttttagaagagagataagaaacatgctccccctcccattctccaagcaataacttggggacataaaccacaccgccattaactaaagaagctaacatcactgctgtctgcaaaggagttacaacaagagtatgctgtccaatcgctgttgcgtataaaccggaacggttatacgccaaatcatgaggcaccctacccgcatactctcctggcaatcctaaacctgttttctcgccaaaaccaaataaagaagccgcgtctgctaaatcttcaggatccccaagaccttcccctaccaataatgaaaagtacgggttgctagacatctctaatgctgagactaaatcaataaagcctcttcccatgaaatcatttcccggcaaactccccccacggaaaaacgtgggaatcggtgtgccatctttaaaaaagcccacgtgaggcttagaactcctatagccaaaggaatttttatcaataatgaccaagggattcgcaggctcctcattatgtccccataagatcctctgagataacacagaatatgcagatactaacttaaaaatagaacctaaggtagctgcttgcccgtaggcatgaggacgtaggtatccgtatccatatactggataaaaagaagcagctaaatcttgttctgtctgcctcttatttctcacaatcgagatgggatatttgcctaatagaggacgttgcaattcattgaattcacgaaatgtagaaaaaagtgcagggagatgttctgaaagatgcgacacacgttcttttagaaaaagataatgttcgtgccaagataacgctctatgcgctccattatctaattcatttatccataaatctaaaatatcatagtaaggctctaagccttctttataaggggttttagaaaataaatacgcaagaaatgtatccaaatgttcttggcagaacattttatattgccttgttttttcttcctctaagtaatctacataaggtgtaggatacctctgtttccttaatgcttcctcttgacgtttcgcagcaagatattgaagaaattcactcttacgccacgacttaaaatgcacctcaataaaagcatcttctaaaatagtagagaatgcagagcgaagcaccacataacgtccttgaagctctgtaaattcagataacgagagcctatgaacctctgaaggaagtacaggagaaaaacgctctggatctacaatcagcctaaggatatccgtatacaagattttatcgtaattcgcaggaagctcattaaaaacttggtctaatgcttccttaagctcttcaatatctgctttatgctgattcagacattccatgatccatttttgttcctgaagagaaatgacttcttggattaagatatgcccctcttcattagggaaaactgcatcaaaaatagcggaacaaggacacgtcccctcttcataaggaaataaagaaagcaaacgagtcaccaagttttgaacctctatcgcctgtcctacaaagctgtttctttttaactgcaatttaatcacagagttttcagggaaaagaaaatcaaggaagcaatcaaaggttaatggcaaaatctcttcataacataatccagtaagaggattccttctttcccgaattagagggactttcctatcataaatttctgcaatatgctctttattttctaaccatcgataaatagacgatcttaccgctttagaatcttccgcaaccttcgcattcacaaaatcattgttacgataacggggagaagaagccatggctaaaatctctccgttattaggatctaacgcaataatggctcctcctttaatccaagggaacaaaggaggaagcttctctcgtttcttcaatgacttagcactacgaaacgtctccgttttttcatattctaaaagtaacgcatccgcatacgcttgtagctcagcagacaaagtcaactgcaatttagttccaggagcttcaggaacagcaccctccatttcttgaatgaagttcccacgacgatctactaaaatcggtttttttccgatcttacctcgtaattttgagtcccaacaggcctcaacacccatttttcctactaaagcatttaaactataagcgttgctctccacagactctaataaagcacgcacctgatctatacttgctaatccttcaggcaacttaggatcttcaccctcttcataagcacgcacacactcacgcaattgactcagctcctgagtgactctcttatactcttgaagactgataggtcctacataacctaaaatatctgaagccacgctttcttgaggataatgacgacgaactacagcctctacatgcaatccaggccaatctttagataacattttgagtttcaaataggtgcgctcagaaacattagcagccactaaataagggaccgaacctaatacagaagcttttgcatgaattgcatcttcgatcgcctcgcgatctaaatgcaattcctgagataaaagctcagacaaacacattatataatgcttacgcacaggaatgagctgtttatgcccatgctcatcgacacgccaagcccgagtaggcaaatcacgaatggccccataagcaacgctcacatcatattgcaactgattcacagccaatgtctttccaaaacgatcacaaatcgttgctctttccacatattgaggaagcactcgaatctgtggcttgtatgcctcttctaacttttgttcatgttcaacaacagcaagataccataaacgcaatgcaatcacagcaaatgcaataacaatcccagacaacagtctgttggtcttttgagcaatggaaagataaataggaaattttttcggtcgtttcatgctatggatattatgagcttcactctcgtctgaaaattacagagaactatgctctcacattatttccaatcatagtctgctaaatacaataataaaaagaagcacgatatttaagaagaatagtcaatctaatcgaacaaaatctagagaagatacagttcgcaaaatacaactaattttagtccaatcaaaacatattaaaaccaaaaatcatgttctaaataataaaaataaacaaaaaaaatttctcaagagaaaaagacttgagaaggtagtgaggagccatttttaaggggaactaaattatatatataatgaaaagaatatacaaaaaagctatagctttcctatagctcataacagaagttcttggttgaaatgtgcggctaaaaacacttaatcttcttatcgtctttactataataagaaaagtttgatatgttttcgactaatgagctgtatgttcatatttaaggccgtttttcaatgataagagcttcctaaatttgcctgcaggatatcttgtctggctttaatttggacgtcgtgtcgccaaaatatgagtaatagcgagcacataaataaaagatactaagcataatctttagaggtgagtatgaaaaaactcttaaagtcggcgttattatccgccgcatttgctggttctgttggctccttacaagccttgcctgtagggaacccttctgatccaagcttattaattgatggtacaatatgggaaggtgctgcaggagatccttgcgatccttgcgctacttggtgcgacgctattagcttacgtgctggattttacggagactatgttttcgaccgtatcttaaaagtagatgcacctaaaacattttctatgggagccaagcctactggatccgctgctgcaaactatactactgccgtagatagacctaacccggcctacaataagcatttacacgatgcagagtggttcactaatgcaggcttcattgccttaaacatttgggatcgctttgatgttttctgtactttaggagcttctaatggttacattagaggaaactctacagcgttcaatctcgttggtttattcggagttaaaggtactactgtaaatgcaaatgaactaccaaacgtttctttaagtaacggagttgttgaactttacacagacacctctttctcttggagcgtaggcgctcgtggagccttatgggaatgcggttgtgcaactttgggagctgaattccaatatgcacagtccaaacctaaagttgaagaacttaatgtgatctgtaacgtatcgcaattctctgtaaacaaacccaagggctataaaggcgttgctttccccttgccaacagacgctggcgtagcaacagctactggaacaaagtctgcgaccatcaattatcatgaatggcaagtaggagcctctctatcttacagactaaactctttagtgccatacattggagtacaatggtctcgagcaacttttgatgctgataacatccgcattgctcagccaaaactacctacagctgttttaaacttaactgcatggaacccttctttactaggaaatgccacagcattgtctactactgattcgttctcagacttcatgcaaattgtttcctgtcagatcaacaagtttaaatctagaaaagcttgtggagttactgtaggagctactttagttgatgctgataaatggtcacttactgcagaagctcgtttaattaacgagagagctgctcacgtatctggtcagttcagattctaaagatttgcttagaatttctcctcaccttgttatcagagtctacatgttaggctctgatttatgctcagagcttcttaatttctgagcaatttttattccccccctacttcacatcacatcaagacaaatgaattatttacttatgctattttctaatagcttcctgtagattacacgcttgcgttaaaagcattattacactactacaccccttaatccagtttgcgcccgtagctcaatggtagagctgtagccttccaagctaccggtgtcagttcgattctgatcgggcgctttctttacacaaccaagactgaaattctggcttttatgtcagaatgccgttgttaacgtattctaattttgaaatagaggtacaaagcttggaatcccaatcctgcaaacttacaattaaagaccttatgagtgccggtgctcattttggacaccaaactcgaagatggaacccaaagatgaaactttacatctttgaggagaaaaacggtctttacatcatcaatctagcaaaaactttacagcaattacgcaatgctcttccccacattcgcaaagtaattcaagacaataaaactgtcctattcgtaggaacaaaaaaacaagcaaagtgtgtcattcgagaagctgcaatagaagctggcgaattttttattgctgaacgttggctaggcggaatgttaaccaacatgacgactatccgaaattccattaaaacgttagacaaaattgaaaaagatttatctagaaatcaggcctatcttactaagaaagaagcagctcttttagctaaacgtcatcaaaaattattgcgaaaccttgaagggattcgttacatgaagaaggctcctggtcttctagttgttgttgaccctagctatgaaaaaattgctgttgcagaagcaaaaaaactcggaattcctgttcttgctctcgtcgatactaactgcgatcctactcctatcgaccatgtgatcccctgtaatgatgactctcttaaaagcattcgattaatcatcaatgtgattaaagaaaatattatcgaggccaaacataagcttggtatagaaattgtttctccagtgaaatctttagaagtgcccgatctctcagctttcgaatctagccaagatgacgaatctgacgaagagaatcgagaagaagatctattagcaaaaaaatttgatggcgaggcaaactaatgagcgacttttctatggagaccctaaaaacattaagacaacaaactggtgtagggttaacaaagtgtaaggaagctttagaagcttgcggtggtaacctagaagaagctgttgtctatttacgtaagttgggattggcatctgctgggaaaaaagaacacagagaaactaaagaaggcatcatagcagctaaaactgacgccaacggcactgcattaattgaagtgaacgtagagacagattttgttgcaaacaacgcagtctttagagaatttgtttccaatctacttaatgacattctcaaatacaaagtagataccgttgaagccctatcgcaagcagcctcgtcccaagatccctctctttctgtagacgaactcagagcagtgactatgcagactgtaggagaaaacatccgtattagtagagtggcatactttcctaaggctacaaattctactgtaggaatttattcccatggcaacggcaagacagtagctctgactatgctttcaggctcctctactgctgacagcttagcaaaagacattgcaatgcatgttgttgctgctcaacctcaattcctcagtaaagaaagcgttcctgctgaagctattgctaaagaaaaagaagtgattgcttctcaaattcaaggaaaacctcaagaagttattgagaagatcgttacaggaaaattaaacacattcttccaagaagcctgtttattagaacaaccatttattaagaacgccgacctttctattcaaagtttaatagatgatttctccaaaacctctggaagctctgttgcaatagaacagttcattttatggaaaataggagcctaataaaaacatggctaagcaaactagacgagtcttgtttaaaatttctggggaagcattatctaaagattctagcaatagaattgatgaaatgcgtttatcccgactggtatcagagctaagagcagttcgtaataatgatatagaaatcgcccttgtaatcggcggtggcaatattttaagaggactcgctgagcaaaaggaacttcaaattaatcgtgtatcggcagatcaaatgggaatgctggctaccttgatcaatggtatggcagtagcagatgctttaaaagctgaggatatcccttgtcttttgacatctaccctatcgtgcccacagttagctgatctttatactccacaaaaatcaatagaagctttagaccagggaaagattcttatctgcaccactggagctggttctccttatctgactacagatactggagctgctttacgagcttgtgagcttaatgttgacgttttaatcaaagcgactatgcatgtagacggtgtctatgataaagatcctaggctctttccagatgctgtaaaatatgattttgtttcctataaggattttttgagcaatcaactaggggtaatggatgcatcagcaatttccctatgtatggattctcatattccaattcgtgtctttagctttttacagcactctctagaaaaggctctatttgaccctacgattggaacattagttagcgaggatgtaaaccatgtctgttctccaagacactgagaaaaaaatggctgcggctttagatttttttcataaagaagtaaagtcctttagaacaggaaaagctcatccagcattagtagaaactgttgtagtcgatgtttatggcactacaatgcgtttgtctgatatcgcttcgatttctgttgcagatcttcggcaattggttatttctccctatgacgggaacaatgcttctgccattgcaaaaggaattattgcagcgaatttaaacttacagcctgaagtcgaagggtctattattcgtattaaggtccctgagcctactgctgattaccgacaagagatgattaagcaacttcgccgcaagtgtgaagaagctaagatcaacgttagaaatatccgcagagaagctaatgacaagttgaaaaaagactcggctcttacagaagatgttgtcaaaggtaacgagaaaaaaattcaggagttaactgacaagttttgcaagcagcttgatgagttaacaaagcaaaaagaagctgaaatagcttcaatataagtatacttagggtttttcttttccctctgacttttttagtcatagagagggaaaagattgctctaaagagagaaaattagtaacatttattcgtcttggccccatcgtctagcctggcccaggacatcggattttcattccggtaacaggggttcgaatccccttggggtcaaagtataaaattaacaagatatttcgggtctttagctcagcggttagagcacctcacttttaatgagggggtcgaaggttcaaatccttcaagacccatttaatgattcttgttaactttatcttttctaaaaaaaatctttttccccttagttctatttttgctatgtactgagtaccgagcttaatggaacttaactcatggttcactcacctacccaccaatgttatcattgtcaacagcctgccaccatatgctatacagaaatagataaggataaggttatacgctcttatgtatgcgcaacatgtccttgtcctagccattactataataatgagcacctgagtctatctaaaggggttggggttctcactttagagtgcggcaactgtaaaaccgtatggcattcaaagcaagacgacgaacaactgttaggctgccaccaatgttatacaaatttcaaaaatcagattaccagcaaactcaaaagtgagagagtggtatcttcatcctttactatggagaaaggccaaggctctcttcatataggtcgagcccctggggaagcttccaatacaaatcctcttttaaaacttatagcattaaatgaagctttacaagataccttagaacgagaggactacgagcaagcagcagtaatccgagatcagattaatcatttaaaaaccaaaaatccagatgacccttcctaatgatttactagagaccttagtaaagagaaaagaaagtccacaggcaaacaaagtgtggcctgtaactacattttctttagctagaaatctctctgtatctaagttccttccctgtttatctaaagaacagaaattagagattctccaatttatcacctctcattttaatcatattgaaggctttggggaatttatagtgcttcctctaaaagacactcccctatggcagaaagagtttctacttgagcattttttactcccttatgatttggtggggaacccagaaggtgaggcattagtagttagcagatctggagacttcttagcagctataaattttcaagatcatcttgttttacatggaattgatttccaaggaaatgttgagaaaactcttgatcaacttgtacaattggatagttatctccatagcaagttatcttttgctttttcttcagaatttggatttttaacaaccaatcctaagaactgtgggacggggttaaaaagccaatgttttctgcatattcctgcgcttctatattctaaagaatttaccaatcttattgatgaagaggtggagataattacttctagtttattactaggggttacaggatttcctggcaatattgtggtattatcgaatcgttgttctttagggctcactgaagaactgcttctttcttctttaaggattactgcttccaagctcagtgttgctgaggttgcagcaaaaaaacggctttctgaggagaattctggcgatttaaagaatcttatccttcgttccttaggtctacttacccattcctgccaacttgagctgaaagagactctagatgccttgagctggatacaactgggtatagatttaggcttgattaaagtaaccgaaaatcatcccctatggaatccattattttggcaaatacgtcgagcacatcttgccttgcaaaaacaagctgaagactcccgggatctgcaaaaagatacgatttcacatttaagagctagcgtattgaaggagttaactaaaggattatctcctgagagtttctgataaaattctgaagatatatttttaaagagagatgcccaaagccgggatcgaaccgacgacctacacgttacgaatgtgttgctctaccaactgagctatttaggcatgtcgtaggaagtagggaacaaaaaagccaagaaaacataaagttatacggccgactctacatcttcttggctttccccctgaatgcaacagagtcagaagctattccacggcggagaatatcatcttcctcttttatataccactactgagcttctatttctattattttaaagtcactttcagcctgtaaagaaggaggtccttggcattcaggagcatggcgaggggccacttgcatggatccttcatcagcttcccaattgtatctgtatccttccttattggtaacacgagtgccttcttcaaagctactaatcaccttaggcttaataaacatcatgatattgcgtttttgcctttggtcgatggtacggctaaataaaccacgaattaatggtatggagtttagcaaaggcactcctgaaaccacttttgtagttttatctctgatatgcccactcataactaagaaacaaccgtcgggaatttgtaagcgtgtggctgcataagttttatctgtgacaggtgttagtgatccagacgcggaatgtaattctgagatcgtctgttcgatttgtagtgtaactacattgttgggagcaactgtagaggtaacgacaaggttcactccaatatcttcataatcgatattttgcgttacagttcctgtttcttggataatagtatttgtagtttggtaagggaccgtttgccctacaaaaaacgaagcttgttgcgtatcctgagccatgattctaggattcaagacaatgacagtatctccatcttgatctaaggcacttaataagcctcccaaagtaaggaaagacttccctttatgacttaggacatttccgatgattcctagaccgaatgctgacgaagagttcagcatatctgagaaccctgtcaattgtcctggcgtaggaagagggatcgaaccaggatttggcgtgccgggagggacagttgcttttgtaggtgtggctatgccagtattattcaatagtccagaagcataagctactttactttgttcatcacctagggctacccattgcactccaaagtcccaggatttctctaagctggtatctagaattaaaacttcgatgtaaacctgtttaggaggtaaatctaaaccgtttaagaggccaataactctgtcgacattcccttggtttccgataataactatggagttattgacctctaaccactggatactattgagagtgttaatgaaatcttcgtccatagctgtggttacatatagattgtaaccgatatcttggagggcattagcaatcacttctccattttgatacttcagcttgtacataaagaaccgcaaactcttagggctcgtggttcctgttcctcccaaagccaaggcagtacttgcaggatcatctagggtatgtgccatttctgggacatctaaggacttcaggagctgctctgccttatttgcaagacgtggtgaagagacgacgaaaattttgttcgttccaggttggatgaacatttggaaagcatcatcttcggccagagtaccaagaacatcttggcagtagctaacaagagctgcgggattggcatatttaacttcgtattcagtcatgtccacagatgtgcctgggcaatctagagctgctagcaaatcactgactttatcgacattaccagcaatatccgagatgataacatgacgagtagcttctgaagcactaacgatagcatcatgggaaagtaaaggttgaataatatttactgctgcagaggggctgacgctgtaaagacggaacactcgggtaaccacaacagcttcacacgtttcttttaaggagctgtctgtgactactgtggatagcttagaaagatgaggattacgatagataaggacgttattgccttgttcaacaaccttcaagtcatgcatttttaagacttgtagtaagattgtagataaatcatctacagaagtaggatcgtgggaaacgatcgtgacattgaattgcaaatcgttgctatcaaagacaaagttcgttccagaaattttacttacgaactgcaacaactctaaaatagaaatgtcttcaaaattgacagtatagccgttatctttaaggtcttcacaggtaagttcccgctttgtcaatcgctctttaactttttcttcttcagatttgtcttgaggtacagccactgttgttgctgctttctcgattcctggcatagaggtcgaaggacttgcaacgtttttcttcgaagcgtgtggtgttgcttgtgttttaggttggacgtctttctctgtaactgtggaggtttgctcttcgagttgtttttttatactcagattgatagcatttacggctctgcgagcataattttgtttttcttcccaaacctgtatactatctaattgttctttagaggcggcaggtacaggctcttcgacttcttgtgttggtaagaagcgtggggatctttttacatcggcagtagttctacgctctggtcgaggtttttttctctcttccagttctttcagggtggtaggttttgctgggaatgcggatcctgaagtcttttggaaagttttatcttgggttgcgtcgaatttagagaagactttactggggatagaacctggagtggttttcttggtatgacttttctttgctgaaagtgaggctgctgaatttttaggacaagcagctaacttttcatctctaagattgtgttttacatttgccgaggtctctgtaggcctctgggaacttacaccaagtaaaactaaatctaaaaaaaagagaccacttaaaatcccgatcttttttttcttttttttgatgccttgcaagatttttcttccaatgttcaatatcacagttttcaccggattctttttaagctaatgagcgttgagggagagttacttccgtgctgacgactttgtattccaccatgtatgctctctatgggacagaatatagctttttgccttctatcttgcaactctgcgagtgatagggtttttaaggatgcaacagattcttctaattccagcgtacacactacagcttcatcacctatttcccatgcaaccttggtttctcgaatttgtaaagaagtaattttccctaatcctggggaaaagctctcaaagtcttggacaacccttccctgtctttttatccagaaaacggttttcccacaagctatccaagagagttccttattttctttcgaaatttcgaggcagagtatagagatacccatttcatctatgggtattttcatgcgaatcaagcactcattgatttcgcatactctatctaaaagaggtcgctgtagatcttgttggcagactaaactttttacaacagacaaagctatagttgcattacttataggactgtaacctaaccacagattaaaaacatctccttcaagcaacgtatcatatgcatgaggatacaagggatatccttgatgatagagaactccggatataaaatctggaaacctcagagtttctggggctaaccaaaatcgttgtgtttgcagctgttcatagagagctaccgtgtgatctttaatacgtagatcttcttgcatgtctccagacatgcgatagtgatgtatatcctggataaactctcgggtcgagctgtagcgattattaggagaaggctgtaacgcttttgctaaaattttacttattctttcgggcactaatgaaagaaagacgcgtcctaaagaaaggtgccctaagatcaactcataagctaacaaacctaaagcataaatatccgaagcgggagaatgagactccccttggcgttgttctggactcatataataaggagttccgataacgctaggatgtgctctctgtatttccgtatcccaatcagcgagtccgaaatctatgagtttgattttaccctgaggagtgatgagaatattttcaggcttgatatctttatgtagaatattccgactatggaggtgctccaaagcttgagcaatatcaaagataatatctatggcttgtggcaaagagataaattgcgcgaggatatactctcttaaagagatcccttctatatactccatagcaatgtagaggcaatcttgccatttgccatagcgatggaacttaacaatattaggatgagtaatttgatggaggctctgtgcttccttaagaaaattatagacagagcgactcgtgaacgagggggaaggagaaaaaacttttatgactgtagaatggcgtgtttcaggatgtagaccatgaacaactctacttcttaattttttactcaatatttttttaacatgatatccgccaatcacctgaggttcaggaagagggatgccaccacgacaatccataaatccaatctttctttatacctctaaaacgcgaatacctaaaacatctcctagagcgataatttctcccctaccgaccttagctccatctaaaatgatatccacaccgtatgctggatggtttcccaagctcaatatacttcccaagttcaattttataaattcactgactgctaaggaatatcttgcaacttcgactacgagtctactgtatccagggaggggagctgcggaagcttgtggattttcaggaagaggagggtcttcatgagttaggttagggtaactggtaattttaaattctccagaggagggcgttaagaaacggccaccaaaaaactgatgtttttgcactgtgagtaaagcgccgctttcttcggtttcaggatcataaagacagctatctaacataatgaatgatcctgggactacctgatgccattcttcttgagttagctgagaatacccgacttctacagaaagagagatctgctgcgtttgatctatattatgaagatccgactcatcatggagacctgagaaaaacttctgacaactttggaaggtatcttctggcaataacagacgacatcgaacattttttccatctaggcgcagagaaatatctacgacttggaaagagccttgcagacttgtagctgtaaatatagcatcccctccgactttggcagacaaagagggcacccactggagctcttcaaataatttacaggcttcggcgacaaaataataatggaaccctaggagcttatctttttcatagaaatatgaagcaaggctggcatcatcaaatactgctaccatgagctcctgaaggtcttcttctgatgttaggaacaacagattttctacttcccaaggttggactaccataggttgtattagaagatgcacgccgaattctttcgtagcttctacagcagttatagatccacgaaactttatagaaacctggacatcttcaagtcgaaatttctctctaattttatgttggcacagttccttaggaaactcaggagcagcaacctgctcctcagtcttccctagggaacttaaaaaattattccgagattttagccaacttgcactagaatcggctgctactgccataaagtacctttataaacgtgcttcttcgattttataagaatcttgttctttatcgtcttgtttttgtttttgattctgatctctttgatctttctcttctctatgacggatcgtagatgcaatcatatgtagaggagtttgtacctcttcaattttaggaagctgtactaaaagatttccaactgagaattcttttaatgtgagttgatgaccttttaaagcacttaccaatgaagaaagttggctagggttattcgttacaaggtctgcagcttctgccatttgtgtagcatctacaaaacttgagaacttaacggaaagatcctgtccagattgcactaatgtaagattagctccaacaaaggcttcaggcacactagaactagcatctaataccaactctacaagttgctcaccgttgatttctgaaatcaccatagattctacagtagaaagtatgatattttctatccactgtgtatcgatactactaacagctatgggagcgacttctacaacagcttctgctgatccagctgctgcgatatctataagagacatacctgcaaaggcgttctcagcaaggcaaaattcttgagattcttgctcttcctctttggatcctacttcagcaatctcatcatcaactcgcttctcttcatcagcaaattttctagattctgtacgtgtatttcctttacttgaggttgttttctcttgtcgtgtttgctttccttccaaagaaaatacttttacatcacgactatctctaggttcaggagagttctggtatacagtgtgattgtctgttttagcgctatataatgattctgctgttttctttaattccatgaactagcttccccctgattcacgtttttttttctggcgcagttggaaaagcagctgccccatctcgtcttgttctttttcttcagcgcgagcttcttctttgagagcttctttcatccattcttctttatggagtcgtgttttctcttcttcttttctacgcttcgctaaatttacttctgctttttcgagttctttagaagcagcaagcacaacttctttttgtttgttgactttctcttcttcttccgaaagctgtactgcaaccactttaatgtacgattttatctgtaagacggcgtcgcttgttgtaccttcgtccaacaaatcgcggagttgttggattttttgcatatagtgatttttaactttatcgcgttcagcttctttctctcgtaatttctcttgttctatttctaaaagacgtcgtttttctttaacaactttttctgctctatctacacgatcctttttaatcgctaaaacaggctctagtggatattttgccacagcatactactctttatttaccggaaaatggcgcgcagttgttgtgctgcttcctcatagtttgtcttttcgtggatatcttgctttaaaaaccggttcaatttgtcaatatggtcgatagcaaaatctatctcacgatcagaacctcgtcggtattctccaatacggatcaacatctcgttggctttatatttagctaaaacttctcttgctttccctatgatccgtcgttgttcttcaggaacaatagcagtcaggagtcggctaatcgaagcaagtacgtcaattgcaggataatggtatgcttgagctagtgcattggagagaacaatatgcccgtcaagaatcgatttgacttcgtcagcaacaggctcgttcatatcatctcctgctaccaagacggtataaaatgctgtaatggttcctttatcggaggctcctgatctttccaatagacggggtagagtggaaaaaaccgatggagtgtatcctgctctagcaggaggctctccagcggctaaccccacttcccgcaatgcacgagcaaatcgtgtcacggaatccatcataagtacgacagttttcccttgatcacgaaaatactctgcaattgcagtccctacataggcggcattaagtcgcaattgcgacgattggtcagaagtagaaacgacaattacggaacgtttcattccttcttctcccaaatccccctctataaactcacgtacttcacgccccctttctccaataagcgcgattacattaacgtcggcttcttcagcgtttcttgcgatcatacctaagagcgaagattttcccactccagcaccagcaaaaattccaatacgctgccccctagcgaccgtgagcataccgtctatacaacgcacacccgtagacaggatctgtcgtaatttcgccctatgcaggggatctgggggtgcacgaaaaataggaaatgtttgatccacattttgtaatggacctttagtttctacatctatgggttctcccaacccattgagaacacgacctaagaggccgtttcctgctcgaatgtgtaaggggagtcctgtagggatgacttcggaagaaggactcactcctgataactctcctaaaggagagagaaaggcaaaactctgggtaaaaccaacgacttctgttacgagaggttccatgccgttacgtttcactaagcatacttctccaacacgcacattaggaactacggctttgattaacatgccgaccacttctgtaatgcggcctactacagtcgtaagattcacatcaccaagttgtgacatgagagtgtcgaaatccgttgttaactgatccatgttaacctaattgcgttgtcataatcgttttcacgctacttacagaggtaccgacaatactcgcaaacagttctgctctttgtgtagctcgctgcacagcatattgtactttaaggaagtttgctaaactctcacgattcccatctctatcagagaagtagagcaacgcacgattgaggacctcttctccggaggagacccaatcaatgattttcctagttaccgaaccctcttctttatcttctttccgagcatcttgttgtgtgtgctcagcaatcgtattcaagtcttcgttaattaaatctatgatgactcctacagcttggaaatgctcgtctgcaaactgtgctgttgtctgactatcttcgaaagttgagcggaaatcccagaggcgccctttcaagttgttaatttgctcttggagctcttctgattccaaggcctcttgcaactcaggatcgattaaattagaattttgatcctgcatcattgccatcggatttggtttaaatccttgaacaagggtcgtatctttaggagcagcataagatcccaaagcaaatggagaaatatctttttttaattcacttgctaagggggtgccagaattctgagttatagattgcgcttctgcatctccatcaaggttggggaaacattctacagggtctatcataaagcaaaaaaaccgttttactgttttaaaagcctagcccaaaggacctgcactttttgccactaaagtgtcatgccaatctaagacagattgagcaagagctcttgtggactctattttacaatttgctatcacttgatcagcaaattttaggcaactttctagactctctctgcgcacttcaaaagaacttccttgatgcaagacgatgagcatatgggtaagagataaaaatgcttttatactccaattatcttcattgccttttatcagcgcactgaggcgttcttcagcatcgaaaagatccattttatgcaaagaaatcaatgcgagtcctagatcatgaccataatgattagggtttagaatatggagagattgaaataactttcttgcgctatcttcatctccctgtttaatggccaaaaggcctgcttcaaataacaaagcaaagtctgcttgaaatacttccaaatctgccatgatctctctcttatattattaacttcctttaactgctctagccattgtgatcatctctgtgttcacagcggttaggatgttggacaccgattccatatactgtgataagatctgcatacggaattgcaaattaaacatggttcccaaatcgacagtgccttgtgttgatgtctctaactcagttaaatactgttgaacacccttcacgtaagtacatacgccgtctagcatcttattaaaatcgaatgctgtgcaacttttatttgtagccatagatttctctcctctggacctttatatcatcttgcggttgatccgacccagaactttctgtagagctacatagcctgctaacaacgactgttgttgcccaaaagattctttgtcagaaccttctcgaagcagcgcatgtaacttatgaactttatcttgcacactagctttaagttcttgagctctgtcatgatcttgcatatcttgttctaaatctaacagcggttgagaatttttttcttctttcgctgtattttccatattaaacatagaatatctacctaaatataaataattaataaaccccaatacttggttatttattgtagtctattttatatttcaacccttccttctctaaaaagatcgcgttaggttgtatacttgttactgtcataccatcaatcacgtcccctcttgtgaggattctgccattgacaactacattgatacttatttctccgtatctagaatagcctgtaacacgatagcgattggggtaacgtaggtttaaatctatgattccctcttcagctgggagtaagacagcaaaattcttgaccaacctcacaccaggaatccccgacagctcttgcactacagcacggaacttctctgcatcatcgttattgacgtaaccagtaaggataacttcaccgttcacaaaggccacatggatgtttgcaaaacctccttgaagaagatggcctgcaattgcttttaacatctgggtttcaacaacaactttattctctagtaacgagaggtaattaaaatgtatatttaaataatcaacgaggcaagctgcttgctcctcagtcttgacatagcctgtgatgatgaatttcccaggttctggggaatgcatgctgatgcctttaaactcgggtcgctttgataacaggatgttcatctcctgccaaacagcttcatcatcaataacattatcatctacggatttcacaaaggaaagggcgtctactttatacagcagctcgcttttgtccgtactatttttgacatgtccgattaagaaaagttggctgttcgttttattaaacgtataacgcaccgtagggaactgattgataacctgggcaagatcttcttgataatcaatattttctaaaggaaccacttctttggtatggaaaagagaagctgttcctataccaaagagaatagccaatcctccaacaaacagggtaagaatgaaagatcctgcgggtagtgtagcgcgtttttgtttttcttcttcttcttgggcctcttgtctttctaaggcttcggcgtcttgctgtctcccaaacaaactgtaatcgtctggggatagagaagcaactatagtatcagcgggggcatgatgatctataagtaaaaataatgtcgttcctaaagccacaacttgattcgagctcaatgtagaggtcttatcaatttttcgtccttcaacaatgacaccgtttttactatcgagatcctcgataagaatgcccccgtcattaccgacagtaattttagcatgttgatgagaaacacttaagtcattaaatactatgtcacaagttgtaggatccgtacctaaaatataggtttttcctgagtctaaatggaactctgctccaatattagctccggctaaaactttgagtaaaaaacgagaaggctgcgtcaagtctacagagatattttttttcgcaatatcatcaatctctgctggaaaaattgtttgatcgaatcgaaataagtcttgaacatgaaatggggatagaactgcgctcttttcgttctcgacttttttaggagtttctttgttatcctctgcagtatggtcacttgccgtgtcgtcatttgcatcagcggcactgtcagaatcttctttattatcttccgtaaggttctcttcttcttcttgtacaaaggcttcttctgcttccttatcctcggattctttttgtgaatccaaaggtgttgcttctattttagagccttcctttttagaaccttcctcaggttgatcttttttttctggagaatccggtgttgctttcttattagccttctcttctacaggtttattttctttcaagggagtctcatccctggctgtgtttttaagagagggttctgctgactttggttgcggatcttgcctaggcgaagctccgttatcttccataatggcgttctggggtttgttggttctttcctctcctttcggagaatcctttgcattttgttcctttggattcaaagactcgtttgaagattcttttaaacccttcttagcaactttggctcttggttgatttttttccgcttttgctgatgctaaaaaagcatcagcaagctcctgatccccacttgtaattggatcgctacttccctgatctttggtcagcttttccttaggcttcggtgaatgatttgtttccgaagtttgccgaggctcaagatcttttccctgttcattactatcggacaaatcccctgaatcattagaaaaattttcttcgggaatatcaaaatcataaacaagatcttgaggatcaaattcatctgataagaaagaatactgattgcttcctaataagatagtatcttcattttttaactgtgtagtttcttggatcgctacgccatttacaacaataggaattgtatcatctaaatttgtgatgtagtagcttccgtcagtcttattgataatggcttgcgatgcaccgagtttaggatcttcaataggaatgtcattagcactagagtcgcgtcctatagaccagcttatcccatcttccagaacaaaaattacaccagacaaggggccttcatcaacaattaatcgtactgccatttattccaccttgttactgtttacctaggccaagatctgacagccatgtctctgaaaaattcataaaactctcaacatgtcgtacaaaatcatcatatgtagtatccccagaaaatctgcggaccatgacaacattgccctcggaatccaaacctaaagcactgcctcctgtttctctaccgaataaattgccaatcatcatttgcaagtataattttgctgtatcagcagatggaggcaaagctcctaacgaagcacttaaaacaatttcgttatcagcattttgctgagcacgcactttaactacctcacttataggcaggacataggctccgtcagcatctaactcgagagttgacgttatacccatatacgtggcaaaattttttattaatttttccaacatactcgtgttttccaacgcagcaatggttgtctttgttccctgaggaatggaaacaatctcatttctaaaacctgctttttcttcctttaaatcgagttatgccaatacgaactttaaaaataaaaacgatttcttatttgcagaaacagcattgagcgcttttctttgctcatctttttcattataaagaacaagaggccacaagaaaaatcgagctgaatccataacaagaataattataatctatcaattaacccgagcacgcccattccctcacagacatcagaggatattcgtacttctaatgaaagcttagagtattttcgaaagctgtatatgtcaagcgatgaattaggcattaaagcatcaatagcttagaacggaaggaatacgtggggatgaaatttgcctctgggttatatgtgagctctttttttcataaatttcccattgttttttcgcggcacaagttaacaaaagttttgctttatttactccttctttggtgcattgcagtcttttttgcacgcattcactgatgaaatctatatctaaataaacaaaacctgtaggggtttctttccataaaaaggttcgtggcacgttaaaatcaaagacaatacgtttgggaatgctagcaagactctcacaggaaagatcggaaaattgtgaagctgattctgaagagccaaagaaaatcacatcatagggttgtcgaaatgagagcgtttctcgagacaaggttctatagggggccgtgacttgttgtctagagcaaaaggtaatcctatgatacccatgttgatataagtaggcagcgactttcctattgatatccgagtatcctacgaataaaaaattcgtatatatcgacttgtcgtagctgagtagaatttcttgaacgacagattctatggtcacttgatgatcgggaaacccgatgcgtgagcgatactccttcccttcctttagagctttttgaaataaaaaatgaagatcaaaaggcaactctctctctttgcttccttttaaataggctcgttttacctgtccttgaatttccgtttccccaaagatcaaactatctataccactggtgacctgaaacagatgagtaaaacaagacaaacctctatgacggtaaggacgtattccctgggatgtcaattctgaaagtaaggcggcttgagcaatttcaggactttctgaataataataaagttcggctcgatgacaagtaagtaacgggataaacgctcctcctttgcctaaaaaacgctgtgcaaggaaaagatttttttcaaaagattgcagatattgaatcgcacgctctctttctttcaaagcggcttcacgataactgattccaacaactcctaacaccataagcacgattcgataatttcagaacagtatgaaggaaacttatactaaatttataaatgaaaagtaacttagctgtatagacgaagagaaaattagaagccatcaaataatctattttctctgctcattgcgttttgaaggcggttgcctatcccatataccagaggatctttacgttgctttaaaaattgaaaggtaattttgactacgatctctaggagaaatcaatgaagaaggcaggcctatgttttgcagttcccgtgttttgttcttccttgattaggaaaaagaggttcgggtaagatgcgttttgagctcctcggggagttccaaggattctgtccttaaatgataagactttagcggatggatatgcagtttaaagctgagttcatgtaatagcgatacattcccaagactaagatccataagtttcgtcttagtacgaaacttatatgttgagcttgtcccttttcttggcgcaaaatagataagcaatcaaaagattgtcctatccgctcttcttaaaaattcaacaaaatatcacacatggcggcatacacagaagcaagcattctttctttggcctctcttgatcacattcgtcttcgggcggggatgtacattggaaggcttggcaatggttctcaaaaagaggatgggatttacactctttttaaagaagtggttgataatgggattgatgaatttatcatgggtcatggtaaatctttaaaaatttctgctagtgacaagcagatctccattcaagatcaaggtcgtggcattcctttaggtaaacttatagattgtgtttctaaaatcaatacgggagctaaatatacccaagatgttttccatttctctgtagggctgaatggcgtgggactcaaagctgtgaatgcactttcagaaatattttctgtacgttctgtaagaaagaaaaaataccaccttgccaccttccatcgaggagttctgcaagagtctaagcaaggttctaccaaagatcctgatggaacttttgtttcctttactcctgatcctagtatcttccctgagtttacttttaaccacgacttcctaaaagataaaatccgccaatacacctacctacattcgggattagagatccgatttaatgatgaggtgttcatatctcacaacggtctcaaagatcttttcgatgcagagatcactgagccccctttatactctcctcttttttttcaaaatgaggatttaacttttatcttttctcaccttgaaggaaatacggagcgttatttttcttttgtcaatggacaagagactcttgacggaggaacacacctgactgcctttaaggaagccatagtaaaaggggtcaacgagttttttggaaaaacatttgtttccaatgacattcgagaaggcattgtgggctgcatagcaataaaaatagcctcgccaatttttgaatcgcaaacgaaaaataagcttgggaatacacagattcggtcttctttaattaaagatgtaaaggaagcgattgtacaggccctacgtaaagataaagtggctcctgagcttcttttagaaaaaataaaattcaatgagaaaactcgaaagaatatccaatttataaaacaagatcttaagagcaaacagaagaaagtccattataaaattcccaaacttcgggactgtaaattccattataacgatcgctctctgtatggtgaggcctcttcgattttccttaccgaaggggagtctgcgtccgcatcaattcttgcttcaagaaatcccctcacacaagctgtcttttcacttcgaggaaagcctatgaatgtcttttccttagaagaaaccaaaatgtataaaaatgatgagttattttatttagcaactgctctaggcatcacgcaaaacgagattcagcatttacgttataacaaagtcatcctggctactgatgcggatgtagacggtatgcatattcgtaatcttttgattactttcttccttaaaacactcttgcctcttgtagaaaataatcacctctttatcttagaaacccctttgtttaaagttagaaacaaaacgactacgctctactactattctgagcaagaaaagatgcaggcgttacagcaatttgggaaaaaggactcctctttagaaatcacaaggtttaaaggtttaggagaaatttctcctaaggaatttgctgcgtttataggtcctgagatccgcctcaccccagttacgattacctctttagagagcatttcttcgatcttacaattctatatggggaaaaatacaaaagagagaaaacaatttattatggataaccttattactgatttttaatttatgcgtgacgtttcagagctttttcgaacacattttatgcattacgcgtcttacgtaattttagagagagcgattcctcatattcttgatggcttaaaaccggtgcagcgtcgacttctatggactttattccttatggacgacgggaaaatgcataaagttgccaatattgcaggaagaactatggctctccatccccatggcgatgcccctattgttgaagctcttgttgtcttagcaaataaaggctacctcatcgacacgcaaggaaacttcggaaatccccttacgggagatcctcacgctgctgcccgttatatagaagcacgactcagtcctttagctcgagaaacgctctttaataccgacttgatagcttttcatgactcttatgatggaagagaaaaagaacctgatattttacctgcaaagctccccgtgcttttacttcatggtgtggacgggattgctgtggggatgaccacgaaaattttccctcacaattttgcagaacttttgaaagcgcaaattgcaattttaaatgataaaaaattcactgtgtttcctgactttccttcgggaggattgatggatccctcggagtatcaagatggattgggatcgattacactgcgtgcatctatagacattattaatgataaaacgcttgtagtgaaacaaatttgtcctcaatctacgactgagactttgatccgttctatagagaacgcagcaaaacgtggcacaattaaaatcgataccatccaagacttctctacagatgtccctcacattgaaattaagctgccaaaaggctctcgagccaaagagatgcttcccttgttattcgagcatactgaatgccaggtgattctctattctaagcccacagtcatttacgagaataagcctgtagaatgttcgatatccgagattctcaaactgcatactacagctctacaggggtatcttgaaaaagaacttttgttgctccaagaacaacttactttggaccattatcataaaaccttagaatacatctttattaaacataagctctatgattctgtccgagaagtcctagccataaacaagaaaatttctgctgatgacctacatcaagcagtgctccatgctctggagccctggcttcatgagcttgcaactcccgttacaaaacaagacacctctcaacttgcttcactaacgattaagaaaatcctttgctttaatgaagaggcatgcactaaggaactgctagccatagaaaaaaaacaagcagcgatacaaaaagatcttggaagaataaaagaagtcaccgtcaagtacctcaaaggacttttagaacgccatggacacttaggagagagaaaaacacagatcacaaactttaagacggcaaagacatctatcttgaaacaacaaaccttaatttaaaaaactaagtttatctaaaaaacttctgattaataagagatggtaaaatattttctttttaaattagaattaaatttatagacactataaccattgtagtacgtatggaaccacgtcacatttatataagaaaaccagagactccaaaagctcctgacgtagaaaagcctggtgtacctgagtacatgacgatggcaaacactcctaccttcgagggtcctgtaaaaactcttgatcagctacgccgagctcttatcgagcaacgaggagctgaggaagggcaaaaaatgtatgataatttcattcagtctattttaatttcaacatttgggcttgtacataaggatatggaccgagcacaaaaagcttctaagcgtatgagatctgtctataaagagcagtaatgtcgtttacctatttcctagcgcttcccgtagataggcttatgcaagaacggttcctctgttctcccaaacgttgggctccttttatcaattcgcctttataccttactctcattgctgaccacgatactccttatttggctaagaatcttgataagtttcccttacctgtagagcaatgggaaaaaacggtcctgcacgtctctagcctattgaagtctatatttttatgttcagacctttcctctttaaggttgctggcctgtacaaaattcgaaatcttgactttgaacgacctttattgcgcccaaaatatctaaaaaattgctttacaaagacactcgcatctttcccttgactaaaaattttgcttgtcaaactgccatcgaagtttgtcatgatgatgtttgagctacataggttagcctcagttgattccagcattttatcttaattcaacgcatttctatctttttagactcattaaattatttttgaaaaattctaagtgtctaagattcaaaaagagactctttctttcaataaaatcgctagatccttaactgattcgatattaaactagtaaagaaagttatcaagatttcaatgaaaactgtgacttcctttactgtatgtaaagaaaactcggggcgtttagacaagtacctgactgaggtgcatcccaaatattctcgagctttctaccaagaacatatcttaagtggtcttgtccaaatcaatgggcaaataaacaccagggtggcaacgcgcttaaattgtggtgatatagtcactatagatatccaagaaaaggaagaacttcttgagctcctacccgaagccatccctctagataaggtttatgaggatggaatgatcttagtgatcaataaacctcgggatatggtggtccatccagcacctggtcatttccatggaaccctggttcatgctcttctccatgaaataggagagagactgaaggaagaattccctgaggaaccttggagacctggaatcgtacatcgacttgataaagatacctcgggattgattattactgcaaaaacgcggcaggccaagaaggttttcagcgagcttttttcaaccaagcggttaaagaaaagctacttagcagtttgtatagggaaacctaggagtactacgatccatacacatataagccggcatcaaaacaaacgtaaagaaatgactgtaagctctcaaggaaaagaagccgttacccactgccaagtccttgcttttaatggaaaactgagttttgttgccttgtctccagagacaggaaggacccaccagcttagggttcatatgaaacatttagggactcctattcttggggatcctgtgtatggaatcccctctatgaattcgagttacggtcttgataaacaacaattgcatgcctatagcgttgatttcactcatccagaaacccggcaattttgttcattaaaggcgggtttacccgaggatatgcgttccctcttaataaaagaattccgcaatgaaacaactatattaaataaaaatttattggaatcgattttaaaagaacaataattcattaaaaagttcatttattttaggaaacgcattaaaattaattaaaattgaatttcattttttaacatctctttttaaagacaacgcgaattagttaaggattactatgaaagaatttttagcctatatcattaagaatctagtggaccgccctgaagaagtccgtattaaagaagttcaggggactcacacgattatttatgaactaagtgtagctaaacctgatatcgggaagatcattggcaaagaaggccgtacgatcaaagcgattcgtactcttctggtttctgtagcaagcaggaacaatgtaagggtcagtttagaaattatggaagaaaagtagccttaagcctagcttaagtacttctcattgaaattgctagcctaagggaaaccgaaggctaccacttcaataaaaaataattgcacgcataaagataaactcggaccgagcaggactcgaacctgcgaccattcgcttagaaggcgaatgctctatccactgagctatcggtccctattcttgtacaaccttggggtattgagcacgaaagcgagcaaaggaaatccctcaatcagtataggtctaccaagaaaaaagtcaattctgacacaagattttcttgttccctaaagaacttctttcaaagctatataaaaagcgaattccacctccttacctgtaattttataggtaaaattaaggagcaacttggattgtattctccgatcttataacctggaaagttagaaccaaaagttgctttattctaaaaaaggatggtcatgttcaataacaaaatgatcctaattgctggcccctgtgttattgagggggaagatattacattggaaatcgcagggaaattacagtccatactcgccccttattcggatcggatccaatggttttttaaaagcagttacgacaaagcaaatcgctcttccctaaactcatttcgagggcctggtttgacagagggattgcgcatccttgccaaagtcaaagaaacttttggcgtgggcattcttacagatgtccatacgcctcaagacgcttacgcggctgccgaagtctgcaatatccttcaggtacctgcgttcctctgcagacaaaccgacctcctcgttgcaactgcagaaactggcgctatagtaaatttaaaaaaagggcagtttctctccccttgggatatggaaggcccaataaataaagtactctctacaggaaataacaaaatcttacttacagaaagagggtgtagcttcggttacaataaccttgtttctgatatgcgctcgattcctgttttatcccgttcaggatttcctgtaatttttgatgccacgcactccgtgcagctccctggagctctatctacagaaagtggtggtctgacagaattcgttcctactctttcacgagctgctttagctgcaggagctcatggcctttttatagagacccataccaatccaaaaatcgctaaaagtgatgcagcttctatgttgagcttagaagaattcgcagctctcctccccacctgggatcaattatttacttgcgtcagttcctttgatatggtctcagcatgacaaaatttctatactgcgggctcttttattctctaggactacttgtcttggcttttgggactatggtagccattattcaagtggaccagatttgcgatgtttcctgtatgaacaagcacttccaagaatcccccccttttttaaaaataaaaaaggtgaatgtctccaaacaaatttgctctcctgaagaacgattcttccattgtaaaattgataaatcgtgtatggaactgcattttcctcagtctagttattcctgtaaagaatacctcacccggatctcagggcatattctaacacaaaattttgaaaagcaaatgcaattccgaggaaactcaggattactaaattaccaagatggttccttacatgtgtatgactgccgtttccaagtagatcctgtacctgggtatgggtctccagataaggaggacagttcttcaggaggtatgaaaaccctctatttatctttattcaggaattaagcctctatgcctatactttctgtgtgtaatctcgtaaagaagtataacaagaagcccgtgacaaatgatgtgtctttccaaatcaaccccggggagattgtcggcctactcggccctaacggagcaggaaaaacaacagcattttatcttactgtaggcttaattcgccctgactctgggaagattatctttaaaaatgtcgatgtcaccaaaaaaactatggaccatcgtgcacgactgggaatcggttatcttgctcaagaacccacaatttttaaagaactcacagttcaagataacctgatttgcattttagagatcatttacaaagcgcgtaaacaacaatcccatcttttaaacaccctggttgatgatttgcaactaggttcctgcctccataaaaaggcaggaaccctatctggaggggaacgacgaagattggagatcgcctgtgtattagctttaaatcccagcgtattgttgttagatgagccttttgcgaatgtagatcctctcgtcattcaaaacgtcaagtacctaattaaaattctagcaggacgtggaatcggcattctaattacagatcacaatgctaaagagctcctttctattgctgataggtgttatttgattattgatgggaagatcttctttgaagggtcttcaagccaaatgatcagtaaccctatggtaaagcaacattacctgggagactcgttctcatactaatggatctcacaaaagtctctagggaaaggagcgctactgtattctgtaagaatccttgctaatacctcaaagccatcttcttctaggatagtgactcctggtttgactcctcgctcagctaatttaaatgccttaaatgtattgcaaatacgtcctgtgagtctgatgcccacaccctttaagttcattacggaggcataatctccaaacatttttaaggaaagttcacaagcagtaactgcaaagagaatttgatatccagggtagcgcttttttaaagtgtgtaaatgttttgcgatatctataaatgtagggatgatcacagtagtgtatctacgagcattcagccgcatcatggtccctatagaacatgaggcacatgtaggatgtgaaggatcataccgacaagcatcattgaaacgcccttcaggacatgccttaggcttttgacaataagaaaatcctaacaaaaggattctatgaggacgacgcatctcctctaaaatatcctcaatattactacagccataaaaaaataggttgccctcctgtaaggcctccttaggagctatcaaagccttagctaaccgagctaaagaaccaggatctttcagaaaatcataggcaagctgtctagcatcttttaaagaggccagataagcaagcgtcttcatacgcagaccccgtcttgtagctttagtaatataaggaatattaggtttgtgctctggtctagacataaatacggaatcataacaattagcaacggccgcacactgccacgaagcacaggggcagtcacacaaaaaccctagaagcattttccatagctcagggaatggcaatattttagatagtatacagcctgaacgataatctaatctagtagaggttcgtcatcagagaggacttcctctgcgattgccttgattgtagtgagaccttcagggaaacctaaactacataataattcatttacatgttctaactctgtagtcagctggtcgttgataaactccaagcgagcgagttgctgttgcatatgagatgttggatgcataagacccctccgtaacgattcataaagaagaggagcgaaaaacatgccaacatctccgcaagattaaaatttttttaagatttagaaatccaagtttagaaattgaagaactatcctgtcaggcttcgtgctaaacttaagtacatttgatttaaaagctgtagagaagtcgcgactacagtccactcctgctgcatagaagtcaggtgcatctgcaaatctaactggaagttctgtcccatatccgcaaaagattgctggtctgactgtattgtagattgcagtgggaacatacccccattaatcatatttcctactaacccggacactaaagcttcttcaagaatctgcaatcgcgcttgccattgctcttgcccctctttaacttcaaaagttcctgctacagaacctccagctatagacaaaggctgtaagtaattttgcaataacactaaagaacctgagatagaattgatgttgtcctcgtagttccttaaggaatctaaaatcgtggagcgctgctcattcgtgattttatcatctttaagcactctagctctttgttcttcaataactgtaagagctccccgtgtttcttggagatacaaagcagcttgctttcgctcctgatccaactttgcctgagcgctttcttgagatcctgggaaggcattcgctcccccagcacctactgccggctgttgtcccacataactagcaaaattgaaatacgtagctccattgacatattgagaaatcgcatcaataatggaatttccgatagaagatcctaagttgctataatatagcttcttatagatttcatttagataatcgacctctttaggcatataacgatcgatcaacacagaggcgactgccgaaggtagggggagagcccgtaattcactagcctgtgataacaattgcccatcaaacagttctgttttcatattggtgaattgttgcaattgactctgaagatcttcgattttgttctgtacattttctgattctacagcagcaagagccttaaaccgaaaataacttcgtgccgtagattcggcgtttgtttttgctagtttcgtaatttctggcaaaaatcctgtagatccataatttaacaggatttgattaatctcaactttgccgtttttctcagaatatatagtatattgtaaggtacttgagttcaccgttacggaaaaggaaccgcttgaatttacaattgaagtcatcgcggattttatagatgatgctaactgaaaactagagttatctaattctttagcttcttcaaggatagcagctttaacgtggtccatggttgcagtagggtttaaagcaactacagtagatgctgtaaaataagcccagatagcaccaaggtgctcaccacacttaaaggtaaccaaagattttatacactcattaatcagtttctgttgctcagcagttaactcattgaaacgagaatttaaccctcgggctgtttgtagagctccagctaaagccgcactactaatatcaccttgagaggaactcagatcaattggagcaaaagttccaattaaagagccaacaaagctagacaaattggaaaacatcgttccttgatgctggttaacatagatacttgcatcaagtaccgtatcaaaggatcctaaagccgcaacttgatctgagtataagtctgttatatgttgacagaacataattttatcatttctagtcaggtcagaagaattaatgactgcggcgagtttttctccagcatcctcaatccgttgtaatcctgcttcatcaaaattacctacatgatctgctaaagcctgcagctctgtcgcaatctcagcaaagatagtaaactgctctggtgtaaggactccttgtaccgctgtaaggatgtctttgaacccttcgactctaccgtctgcaaacgtttgagttaaagtagcttgatttccatatttgcctgccaactggttcgtaaagtctgttttcattcccccagtaaacgtatctgctcgttggattgcagtgaagatctcctctgggaaattgtagagagtctgaaaattctcttctgttaaattattccccgcagcgactaaagcctgaagttcagtatttaatttatcaaagacatctttatttgcaggattcttactattaactgaggccatgatagtggtcataaccgtattaagctcaacgataagatcttgcgcccacttctgttttactgcgttataataggccccgactccagatcctgtagctgctggcgtacttgctgtaacctgaacagatgcatgtgtagaggaaagaggtttctcatgaatggctgccacaggaatagacttcgctactgtcgcacgctccacttcatatttgtgtagcttctcgacggcagagcggtagcgctcgctcgccctctgatccaaaacttcgatcaaccgttttagtatgtcacgttccgctgtagtcttctcataattagcgatatgttctaaagattccctgtgtctttgtgcaaaagaatgcattgaagacactagagagagttttttataaaatgttgaaatagaagtgctataaatcatatcaatgtctgcttagataagaacagtgttatttttaattaacattaacattaataaattatttttttaattcaaaaaattcgtcaaatgtttaaaaagaaaactatcaatattatagaaaacaaattattttttatttgaaaagcttcatagaaaaaaacaaaacaaagtacgaaaataaaataaaaatattatttattttctatgtctaccttttctatccaaaatcgactaagaaccatttcaggtgaaagtactcgaatcatcaagctggaccataagtactctggttttgatcccagatcagtgcctgcgataaatttagaagagttaaattcagggatttatgctctaaggcatttaatgaacgccctgcaatcagaaaataccaatgttgctgctttattaaacccaaacaatacgatcttccccacaacatcttggacagattacaagcattcgcgtccgcaagctagctctccaagagcaccctcatcacaaactcccacagatatcgtatcagcagcagctcttgctttagttcttgttattgacggaggtctagcggaattagtggcctccgttacagaaattgatctcggagctttatccactatatccacagttcgtcagttaatggcgagctacctcggtttgacaactctaacagctgaacaagaaaaggttgtattttccagctcctatgttccttcagaaaaaaatctccttgaacatgtaaaacaagaaaaagctgctgaaatccaagctaagcaagaagaaataaaagcagtattagaagctaaaggagtctctactgaagagatcgaagcgatacttaaggaatatcctgatatctatgcagcagatttcttcaaagagtttatagaagagcctttacatacatatcgtgcaaaagtcggcgcaccgatccaagagatgaatgagaacgcgattcagctgcttcctacacctcctgcgatcactcctgacaatgtcaatgaagtcaacggaatgaacaccctcagcactattttacaagctatagatgatgctattaaacaagctcctgcacttggtggggatcaggaaatcattactatactacaaactttggttcccctagtcgataagaccacgtttacaaaagctgaattcgatcttatttacacagcaacacaacttcctaatacagcatctttaaaactctaccttacggatagacaaattgctgagtatcgagggaaaatcacgaaagtatatcaaaattctatccaaaatctctctgagacaaaacgtgtagttgaaaacaaccgaagcatgctagaaacacaactctccatgttccaacaagcacaaaattgctttgttacttggattagtcaagccaatgcacttaacatagccatcactaataaatatatttctgctgtacttacgacttctatggagatgtacggaggtctcctttgcctttcttatatgtacgaaaggttagccgatgatgaaaaagcaatttttgacaaaagtgtgaatgagtatttaccgattcacatcgttgttggtggttcatgggtaaatggctggatagcaaaaatggcagcctatcaagaactcgcggaatactctttaggaaccgcagttacaagtcaagatcaaatcaaagcttatttacaaacacgagggaatgagtttaaagctacgcgtcattttttccataatattggggatcaaatgtaccaatttgctaatgagactgtctttggaaattgtcttacaacagcaaatggtgcgatacagcccgatttaggtggttttatcagagaagcaatgacgaatgttggaactgttgaagccgattatgtaagcaatgctcagaggatcctaaatgaatttaatacggctgcaactgcgcatgttttacaattacaattacaaatagctgagttacaaaagaaagcagatgacttagacccaggaaaagcctctttcactgagaaccgtaaatttgctgttgctgcttggatcacatcggagagcttaggagatgctttaatttctatgattttaaactctcagctaccaaagcaagaggcttttttaaaacctttgatcgaagaaattaacttcaataacctcgcagcgaatgccttaaacagcttgctacagattaccaatgaattttctacgacttctgtctactatagcctctcttcctatttagttcagagtaaaactggacaaaacctgtttgctggtgattactatgaaacacttctagctgcagctagagaacgggagtatatttatcgcgacactgcgagatgtaaacaagcgattaatctagtcaatggacttctccaaaaaattaactctcttccaggggctacctcagcacaaaaacaagaaatgcttaacgcaactacctattatcaatacagcttatcagtcactttaaaccaacttactgtattagaatctttactcgcgggtctcaaaatgactcttcagacaactagtaataacaaatacgacaaaagtgtgtttaaaattgaaagttttgatgactggattccaactctagctgctttggaaagttttctaactagtggattccctaatatcagtgcgacaggaggcctaggtcctttatttacccaggtgcaatccgatcagcaaacgtatacttctcaaggccagacacagcagttgaacctacaaaaccaaatgaccactatccaacaggagtggacattagtttccacatccatgcaagtattaaacggtattttatcacagcttgctggtgccatctattccaactaattgcatccttaggagtttttagagctcctaaaggatcttttcttctcctttaccctatactttttctttatccatctgcagcttagaaagaacatctcctaagctgctgatcaattaacaagattggaatcaatcatggaagagaaactctaaaaaagtatagaggaccttgcaaaccattctctaaaatcaaataaaagcttagaaaagaagtttaaaactggtgtcttttatttattgaagatcgttctagtgtgttggtaaggcctcaacaaaggccttaccaaagcacataataatctctccaaacgaacacttaggtgttgttattggagataaccagaatatagagagccgatattgaccagcacctgctgaataaacaaggagttcgtttcaaaggaaagtgcttttatttcagctgctgtcctagatccttcagcaaacaaactttctaatttagctatgaacttctgtgtagagtcattagaaagttgcacataaggatagccaaactgtggaggctttgtcactgccgatgtaagcttttgtctgatctcctcattattcgcttgaggattcgactggatgatctgcattacagattgtagtgccgaaacttgactatagacatctccaagagttctgctattgccagaaatcaccctagcgagggcttgatctgttttttctggtcctcgagcttctgttcgtgctctaggaacggatcgtgtgagagcgggggtacttacattgtttatcacatcacgagtcgcatcatttcgtgccctaccataggcatcattgatggatttgtaagcatcataacctgctgatatctgtgttttataatcagaacctgtagattttgaggtcttgtaaagctgttttacagatgaccctatagaacttgctgcagcgggaggaactcctgcgctcacaacagcagcagaagcgatctgtcctaaagcattgagtatgccctgttgttgcccagctttacctagagccgcttctaaagctttctgagcatctgccagcgctgcagcagcactgtcatctccagcggctttcgctgctctagcttgtgctgcgagctcctgttgggcagcttgagaatcaggattttccgtattgaacatgtgaatcatctgacgaaacccagacatcaaaatggaagcggtctcattttcagcatcatctaacagcatggaaacacgaatactaccaatactacttccttgttgcttggagcctccaactgtagttcctggatttggaacatcagaaccatctgcaggtttgatatttttaagatctttctcagcctgtattaccatttgttccgcttcttgaagaattggagagtcggggaactttttctgagcttcagctatttgtgtcttagcagtagcgattgctgctttagctgaatctatgttgcttatactgttattagatttagcattttctacagctccactagcgttctgtcctgcaaaatatgcatccctaatcgcatttccatctttctctatctgtgtcgctgtagcatctgtctgatcaactaaagattgagcaattgcaggcgttttccctgggactactgggttatcttgcatctctttaagaagctcagctgctttgttattgtttgctacagattggagaagagcagcctgtaagaggtcgaaggaagtcagtttacctaaagagtcaagaatcgcttggttatccgaagcatatttcgctaattctgtaatttgcgcgccaactttaactgcatcggcattcttagtttcccactccgcagcgattgcggtttcctcatcagtagccgctgtatcctttatattagtgacagcatcctggaggctcaccaaagcagcctgtatgtcagctagtgatgttgaggtaaagatagtatcgtaagctgtttgcgcttgagtcttataatcatcaaacgtgggtggaggaggcgtaggtgcggtcgctgtcgttgagtccacgtctgcagatctgctagtagaagacgagctgttactagaagcaatacccagcttatctgccagactcatgagagcattcactgcagaacgcaagatgctccatcgctctacagaatcggtcttagattctttaggcttagcttccgcacctgctattctttgagcttccgcactcttatttgctgcactcgcctccaatccttgagcagaaagatctgcgggaggtgtgcgttctgtttcgtctataggacctggaccaataggattaaccataaaaactcaaaaaataataaaaatcttttagttttattataaaaaataaaaaaaaagctctcactaataattaatgcgagcctgtttttaaagattttattaaaatttgacttaaaacgctgaaattatacctagatcaaactttcggaaagtaaaatcactgccgagtttatcgtttgctggtttggagtaagccccataagctctgaatgatagagaatctgtgatgccatacatatatagagcggaaaatcctttataatttgtaaaaccattagcctctttaggatcatagttagcagcaattgcttgggcgaaccaaaactttaataaattaccacggccaatccctgaaacatctatttctggaaccgacaaggcttcgacatactcataacgtactgtggcagaccagtctccagcttttctgagtccccctaaagttcctccaataaaccaagctaggttttcttttccatttaacgtagtcttcgtagcctttgctaaagggttcattaagaaagctccataaagatatagaggctttttctgtccattgatccaaggaacctgactatgctttccgacgagccactgccaaacacagtatttgtatttcatagcgtttgtagcagctttttctgtagtggaggtttctgaaggaacgaatgtgttccagtcgacaacactacatttcacaaaaaactgtttaggcaaacgattgagaatcccttctacaacccaagcataatgtttttttgtcatgttcacgacgaaaggacctccatgaacaatcacttgataaggatagtccttagaaagttctcgagtccaatatatatgtagtccgtcaaaattactttggaattggacttctgactcaaagagatctcctaaaccagaacgtccgatttccataaagaaatctgtacgtgtttcgggattcttataaaaacgatatcctagaaatgctctgttgatatcaacaccagctgcagtgttttcccctcctgcaattgctgtccaattcatctttgaagacagccagttcctctcagcgcgataatcaatatagagataaaattcactacgataacgatttactggtaagggattgtatttatctttatctgaggggtttttgatatcttctctgaaatacaaccaccgggctctaacatctcctgctattcttaaaacgccatcttgctttcgcgtttctacaaaaccccgtttacttaagtagtctttgacttcgtctaaagttgtataagtgtgactttttactttttgttccgagagaggaagttcagcgtatcctgaaattgtcagcgctaaaagaaccacactcgctaaccattgatatacctgttttttcatagtatccttagtatcaatattaagtgtagaaacagaagaccaagcaggctatcaaaacttaaagctaaaagaaagcgactgagctacaagaaacaaacatgattaattttgagtgtcttgcatcacgtgttgtctttgcaaaagaccccgttgcccacgccagtattcaaaagaagccaaattaataagatcttctactcgaagcagttttgcaaaaccaaacaaaaaagccaagaaaatgcagctctcagataaaaaagcaattgcttgagccgttatggaggataagggccaagcaagtggtgtgagggggtttaagaaaattacatatgtagtttgcgtaaggatatttaagcctagagtaatcatacaagcaagcatagtggttcccataacttttatggaacgccggatgctctcccaaagtaacttagagtacatagggagtcttttcgaagaataataccagaggaaatataactgcacccaagcagttatggatgtagcataggaaatgcccgagacgtcttttaaaacccaacgacctagaaccaagcttaaaacaatattggccaaagccgtaccgattcctataaagagcggaacagcatactgccgctgtgcataaaaaagaacagagactaaaggagccaaggccatagggataatactggcaccataacctcgcaatacacgaacaatagcgtagacagcactctgagggaaaagtccgtgttcataaaggacacggactccaggtaaagctaagagcaatagccctgctgtcataatgatcattacggacatggttagggtgagaacgaacttcataagtttcaatcccctctcatgatcttctcgctgtacacaacgagaaattgctgggaggagaacggtaaacacaccaaagccaaagagatgtatggggagctgataaatctttaaggagtacataagatatagagggcctatttcatgtacatagcgagccaagcagatatcagaaagaaggttcagctggaagatgcttgaagttaaaatacccaaagataagggagctaataaagctcgaacactatcgtgttcttgaggtgggctcttcgcttctaatagaaatttccatactccaggaaccgtgattaaccattcgaagaaaaacccgataactagagccacggataaaccgataatacgctctctaggatctgaatgacgagccgctataacaaagaaaatccaaatgatatttacaactacgggagctaatcccaccccgaaaaacttattttcacagtgaagcaaagcgccgtttacattgtacatcattaagaaaatgccacagggcaagagtatcatagtaaggagaatcatatcgtaagtcccctcttcaacgtattgaagaactacccacaatactgcttcaataagcagagtgaatataatagtgctgcctttaatcaatctagaaaagcgtcggaaaaaaaacgccgcacgatcgagactttgagcacggagaaattcaaaatgagggatgaaggcttgttctagaatgagccctcctaaaatttttcttaagaaaaaaacagtacggaaacctaaccagaaagcagctacaattggatcagctccaaaataggttgccattgcaatttctcgaaatatccctgtaatacgactacagaaagttccggataatatattaaaaattgaacgagctaaggaaacctcattgtcttttctgctcattaaaccgttttcccctcctcctttaaaacaagactatctcttcgacatttccccctatacttcttcagaaatcacaattggaggaagctatttcaagctaaataaagcatctttacagagctctacattgcgtttgagaagcataagtatcatttcataatctctatgatatcgacatagaaagaagcctttgtttcataacaccgtaaacgatacctgtcagcagcttttttctatataaaactgatgctttcttcttataaaaagagctttttatggatgattctttaaaatatattttttctgtattattgcgatactgcgcattcggttttgttcaaaactcaagaatatgaaattctgtgggggaagacatacgaaagttattattaaaatttttgaaaaattgaaaaagcctcaagaaatgggcagctcaatcaaaggacctaggtttcctctgaaactgggtagttaagaaaagaccttgaaattttatgaaagtacttcctcctccctccattcccttactaggggctcacacttcaactgctggtggactcaaaaatgcgatttatgaaggccgggatataggggcttctacagttcagatttttacagcaaaccaaaggcagtggcaaagacgggctctaaaagaagaagtgattgaagatttcaaagcagcgctcaaagaaactgacctttcttatattatgagtcatgcaggatatctgattaatccaggagcccctgatccggtaattttagaaaaaagtcggattggcatttatcaagaaattctggactgcatcactttaggcatttcttttgttaattttcaccctggagcagctctcaaaagctctaaagaagactgcatgaataaaattgtcagcagttttagccaatcggcccctttatttgatagttctcctcctcttgttgttttactggaaaccacagcgggtcagggaacgttaattgggagtaactttgaagaattgggttacctcgttcagaatttgaaaaatcaaattcccattggcgtgtgtgtagatacttgtcatatttttgctgcggggtacgacattacctctccacaggggtgggaagatgttcttaatgaatttgacgagtatgtcggtttatcttatctacgagcctttcatctcaatgattctatgtttccattaggagcgaacaaagaccgccatgcgccccttggagagggctatataggtaaggaatcttttaaatttttaatgacagatgaacgaactagaaaaattcctaagtatttagaaacccctggtgggcctgaaaattggcaaaaagaaattggggaacttttgaagttttcaaaaaacagagatagttaggaagttttttaagtgcttttagatcccgaagcaatccagtagatcttctgaaatcaaaaaaaacgccatactgatatacagttggcgttttctagaaaagattctaaatcaactacacttatgttctatgagataggaactcacaaacaacagaaatgttgataggtagaggcaattgagcctcgatttgatcttgctcaggagatacaagcaattcccctttaaagcctgtcttatctaaagaaatgtaagaaggcagagaactttcgtctttgctttctagggcatcttttacagactgaagtcgtttagatttttcttttagagaaatctgcattccaggacgtaaaaagaaagagcgtctatcgactcttcgcccattaactaagatatgtccgtgagcaacaagctgctgagcagcaaaaattgtttttgcaaagcccatacggtataccatgttatcaagacgacactcaaatctttcaaggaacatttgagcaacatttccctgcttatgtataacttctttgaaagccttaaccagctgcttttccataatcatgccgtagcaagctttaagcttctgtttctcttccagttggagcccatagtcagactttttctttctctgcataccatgttgacctggaggatgaggcttctttaacaaaggatttcggcttctgccaaagatgttcgcaccaaaacgccttgccactctatttttagggccacaatatcgagccatgtatttcagtccttatatttaatccttggaaatcatctatgccccttgattttcatcctggggcaattttggcactattttacaaagctcaaggtgcggagtaaaataaaaataaaacgcacactcataacttgacaaaataccaaagagcattttagttctaatggcaattttctacaatgcaattatttccaagattatgttagagtatttatcatggaaaaaaaatattatgcactagcctattattatattactcgtgtggataatccacatgaagaaatcgctttacacaaaaagttcttagaagacctcgatgtctcttgtcgtatttacatttcagagcagggtatcaatggacaattcagtggttatgagccccatgctgagctctatatgcaatggcttaaagagcgtcctaatttttctaagattaagtttaaaatccatcatattaaggaaaatatctttcctaggatcacagtaaagtatcgaaaagaacttgctgccttaggatgtgaggtagatctttccaaacaggcaaagcacatttctcctcaagaatggcacgaaaaactccaagaaaatcgttgccttattctagatgtccgaaataactatgagtggaaaattggtcactttgataatgcgactctacctgatattcaaactttcagagagtttccagagtatgctgagaagcttgctcaagaatgtgatcccgaaaccactcccgttatgatgtactgtacggggggaattcgttgtgagctttactctccagttttattagaaaaaggctttaaagaagtctatcaacttgatggtggtgtcattgcttatggacaacaagtaggcaccggcaagtggttaggaaagctctttgtttttgatgatcgcctagctattcccattgatgagagtgaccctgatgtggcccctatagcagaatgttgtcattgtcaaactcctagtgacgcttattacaattgtgcgaacacagattgcaatgctctatttctttgctgtgatgaatgtattcatcaacatcaaggatgttgtggtgaagagtgctctcaaagccctagagttcgtaaatttgatagttcacgaggaaataagccttttcgacgtgctcatttgtgtgagatcagcgaaaacagtgaatcagcaagttgttgtttgatttaatacctattctggtttcttcatctgggagttgtaaaacttagaaaagtgaagaaaccagaacacatgtctcttaaaaaaaaattacttagagttgaccatataatacgtctcatcgctttccagggcattctctaaatgatttttaattttctgtgacaaaatatttgttactacgttttgtcggtaatttccatgtacaatgatatcagcatatttccgagtcggctctataaatttctcatgcataggctttaccatagaaagataacgagacatgatgcagtccacgctatctccttgttcttgaacatctcgaaccatacggcgtagtatcctttcatcagcatcggtgtctacaaagatcctaatatccataagatctctaagttcttgattttcaaagaccagaataccttcaacaagaataactttagatggatagatcgtttctatctccgttttagatcgattacctaaaacaaaatcaaaaactggggcttggacaatctcattattttttagacgttttatgtctgaaattaataagtcattatcaaaggcgtccggatgatcccaaattaaattggcacgttcttcaggagtataatgagatctatctttgtaataattatcttggcagataacactcacatcctcaccgaaaatttctttaatgttttgggttagggtggttttcccagctccagaacctcctgtaattccaataatcatcataagcatcatcaacataaatttttctccttagtacttctcttgtaatcagcacacaacaaaatgcgggtcctttgagaatttattgatttaaaaggagacaaaagaaaaagcttcgtgatcagaaaatgactatatctaaagatttcaatttctgatcacgaagtttaggatagaattctatccaaaaaaatatttcatcccccaataaacaagggatgttatacaaaaccccaattcacgtatagatagatttaaaaaagcaaaaacactgtcagaatgccttataagaacgatttacggtatcttagatgtttcctaaaggagtacaagactccttatgcatgaggaaacactagagtataaatcactctttttttcccttctttctgaacaagttgtatcggatgcaagtcgataccttgttcttgtagtatggatgtaaatctctctacattcttgggtagtcccaaacatacaacactgacatcaggaaattttttcaaagatgttttcaggtgatttgcttgtagaacagcccaggcatcttgggcctcagaatcgttatctctaacactagagacaactgtgggaacacaccaagacaataaccacgctctccatcctggcactaatttttggtcgagaatgatgactctgcttctcactgttttggttagagcagctaaaacacgtcggatttccctataactttgtacggcaacaaaataacatttcgggctcgaagactggtggatttttaaatagtaacctagctgccgtcttaatatgatacccaacaacaggcgatagacgtgttctctccatatccataatgtccagatagagacagcgagcacaaaccaaccgatatagaaaaaacttgtttcaggagacaagcctaagttacttcccaaaactcggatcactcctgcagcgactaacactccaaagaaatctaaaaagttattggcagccaaaatttgccctctcttatgttccgggcttgcatattgtacataagcatggagaggcacttgatacaccccaccaagaaatcccagtgcgagtaaaaaaaacaacacgaatagtatcgaacaagcaaaggcatacagccccataaatacgagagctaggccgatagcggccaaagggacgtatcctattttgatatcttttcctgagattttcccggtgatgtacgaccccgtgcctacacctaacgccactataggaaacaagtaagcgccataatgcttaggatattttaaagtaaattctacaaaagggatgatctctagctgagtataagcacctatcaataagaagaaagatcccaaaaaaatcgatacagtcaaataatgaatcatccgggtatctttcaaaactttccataaatctttgaaactcaccaaggtgattttctgtttcacatttttcacattgctaggtcggatacagaaggaaataagagtactgataatagaaacaataacacacattaaggtaggccagacatagctatttacacctaaacgatgagttacatcgacaagaagaggagcaaggcaagaacctaaaatacttcctgtataggtggctgctgtcataatcccgttggcttgggagagctgttctgagggtagcatttcgggaagaatcccgagctttgctggcccaaagattgtggtgtgacatgccattaaaattaagactacataccccccaactacagattggataaagaaaaagtacgttccgagaattgtacataaaatctctataaatctggttgctaagataatattccgtttctgaaagcgatctgctaaacttccagctagcggagctagtaaaagaaagggaagggcaaaaaagaaacttacacaggagagaatctttgcattctctgttagagttttgccttccaataggaaaaacgctaaaagaaatttatataaattatcgtttataatcgtcaggaaatgtgtagttactagtgccctaaacgatttttttttaaccgaaacagtcatgaatgccaccaaacattgtcgagcaagcttcagtaactcgccccgtcacctcctagctcagcttgcggaggatattacgtccacacatcaaaaaccttttaccaaaaggtggattcttgttgcaaatgctactacagggcactggataaaaaaccaacttgtacatgtcttgtcagaccacatctttatgggatcaactattttcactgcttcggattccattgtcaaacacttattcttgggttcgggttgctcgcagcccaatattccggactaccttacccttcccttgttaataaataatattttagaagaaatctcgaaggcttccaaatttgaaaatggaagggagtttttatctccacccacatacgaaacaacaaaaaaacttgctgctgcgtttaagcagttccatacgttttcacaacgcccgaccaaaaacgcctcccattaccaagaattatttcaaatcttggaaagccatttttcttcttatgaagagatgttcaccactattttaaataatcgaacgcaagaggaggactgctcccttcatatttttggttatgctcatcttcccaaacatcttgcggaattttttattaatttaagtacgtatttccctgtatatttctattgtttttctccctgtcgagaatattttggtgatttactttccgatagagctattgatttcttttggaatcaacttcccgactccccaataaaaaatgcctgggaacactatgtattatcagacaggcaagcacttcttgcaaacttagctcataaatctcagtcgtcgcaaaattttttcctagatagggaaatagactatcaagagatgtttctcccttcaaaacacgatagttctttaggggtaatacagaactctattttagacctcaagcccacgtctcctcaagatttctctcaaacaaagcagaccatttgtatttatagagctctaaatattcccagagaagtccaggaggtattttgtaaagttacagaacttctgcatcgcggagtgtcacctgaggagatttttattctctcttctcacatagagagctacaaggtacatctaaacgctattttcaatcctcatgtgcctatatactttactgatgaagtagatccacgggctgaagatctcagaaataaaatcctcctactttcttctattttacaaacacaaggggatttacattacattcttcaactccttacgcacccacaactacaacaacctatagatcaaaacaaggttccctatctgattaaaaagctttcctcagaatggggaaaaatttcttcaaaagaccgagcttcgggtcaacaaatgaaagctctaggtgatctgatattagaagaatacccattccatcaagagggtgggcgtgtgagccaagtagaagtttgggaaacaacagtacctttaatttatttcattcaagagcgtatcaacctttatctttccagctcccaacatagctatgaagatctatttcaaaacgtgttttcttgtttagaaaagatttttgttttatctcccgaagagacctctttcattacaacgttaaggaactctcttttcccaacctttgctacatcttcctgttctcttctttttttcactgatttctgtttagactttttgcttcatttccataaacccagtcccctgtatgacaagccaggaccttacataggtagtttgagtagcctcagcttaattcctaaaggctatgtctttattttaggagctaataaaacaacatcgtctgacatttttgatcttttaaataggacaacaacacatgaagagcttgcattttcttctacagaagacgaggaaaatttccacttcctacaaattttagtctctacaaaacatgaacttcatattagttatatatcatcggcagcgcaattcaaccttcctagtccctttctaaaccatattaaagaaaccttagacctgcctgtagaaacgttacctacacaaccctacctctctgctttcttcaagaataaagcttgtttacacacctctcaagaatacaactactctcttgctcatgctttctattctaaaaaagctctcctcccttccttgtttattccaactgtaaagcaggtaaatcttcctcaacatctctctctcaatgaaattatcaaaggaatcttttctcctttagacctctttttaaaaaccaattacaatctcagaatttcctacccagaacaccttaaaaaacaacagaaactctttccaacaaaacatcaaatcgaagacttttggaatgaatgttttgtagacaaagagcatgacctgatccctagtatctctcctcatgctgaagagctttttacttactatagggaaaagacaatcctattgcgtaatggattggacaaagatccgaaacattcaccttatacagtcacattctcttcctcaattttcgaagagagaccctatcatgaaagttaccttttcccgcctctttctttatctttccaaggaaatccggtccaaatccatggaacaattcatggggtatgcaatgagggactttatttatgttctatagatcctagagattccctaaaaaaaacaaccagaaccctagggagtctcccagaaacctcttctgaacaaaaacagctcttagaaagatatgtagcgttggcggtgttacaaatgtctcagcacctctcttcagattcggctttaataaagcttacatcgttcaatactaaagaaaaccaccatcctcctttttcggatcctgaaggttatctccgtaaagttttagaagtctatcacctgatgtcttcgcaacccattcccctactttctccattatgttggaaaaccttagacgatgaagaaaaatttcatcaggcagtactttctgctataagtgaagaagctaaaaatccttctcttcctattttctggcagtttcacaatcgtaatatcgaggagatcttaaatcacgtgggtgcatccgaacgtttgaaaattttatctcttttcagaggtccctgtgaagccgtttaatatttttgactcaaactcttcgattcagggaaaatttttcctagaagcctctgcaggcacaggaaaaacatttactatagaacagatcgtgttgcgagccttgattgaaggctcgctaacacatgtagaacatgccttagcaattacatttacgaatgcttctaccaatgagcttaaggttcgcatcaaagacaatcttgctcaaactttaagagaattaaaagcggttctaaactctcagccggcttctttacccacatatttagatatcaattgcaatgtaaagcagatttacatgcaagttcgcaatgctcttgctactctagatcagatgtctttgtttacgattcatggcttttgcaactttgttctagaacaatattttcctaagacccgtcttattcacaaaaaccctgctctgacccactctcaattagttcttcatcacatcactaactatttaaaacaagacctctggaaaaatgtactttttcaagaacagtttcatctattagcagttcgctacaatataacctcgaagcatacatcttctctggtggataagctacttgccagctatacccaaccaatctcctcctacttttcctcacgtgttgaaagacttgagcaaatttctctttggcatcaacaaatatacaactctcttttagaaattccaaaacaggtttttctagatcagctaactgcccacatctcaggatttaaaaagcagcccttttccattcttgatgatctccatcattttgtggatctcctttacacttcggagacccatagctctttattttcattctttaaaattgcagaaacattcaacttcaaacaccgtcttgcacgttacaagccttgtgctgcctttactgttttagaaaacatgtcttgggtagagcgtactttagagttttgtaacttggatcgaatcttcaatactttgttagtcgatctccaagagtatcttaaacaaaattataccccttggctctctcccgatgaaagcgtctttgccctcgagaaactactctcttcatctgaagctcaacctgtagttcaagctcttagagagcaataccagctcgtattaattgatgaatttcaagatacagacaagcaacaatggagcatcttttcgaatctctttatttctccgaaatttacaggatcgttatttcttatcggagaccccaagcaatctatttatgaatggagaagtgcggatcttcctacctatcttacagccaaatcttcgttttcagaagacaagcaactacagcttgtcaataattaccgctctacacccaaactcatggaagccatcaaccaaatattcgggaaaatctctccatttttagagatccctggctacctacctatagaataccatgcgctaaatcctcagagtagtgagacatttgaaaatcccccccacgctcctattcatttcttcttttatgaaactattaaagaccaggcattatggatattctcagaagcgctaagactacaaaaagaacaaaagattcccctagggaatatggttgtcctggtctcagactcaaatcaagcttttgagttaatttcctatgcgactattcctgtttccttttctaaaaacaaatctatatttcatcttacagaaactcacatactgactacagctctactagaagccattcttcacccggagaattatgaaaaaatcagcaagatattgttctcatctctttttggactttctttagacgaagtcacaacaaaaaaagaagactttacgatttatttccaatcactacatagctacatctcacatcatggacttctggctacattttaccgagtgatgactacgcaaggaaacgtattgttctcatctcctagaggggatcttatttttcaggaaatggagaaactttgtggttacctagatacaatttcttcttatccctaccaccaacttcttcacctgaaaaacttttctgaaacaggacggtgggaagaagaactcgctatatcttcttattctgaggacttggaaactttaaaaatcactaccattcactcttctaaaggtctcgaatacgatatagtcttttgtccaggaattgagaaaagtaaaaaaaataaaagctcttcagaattactaagagaaatgtacgttgcttgcacgagagcaaaaaaacagctgtacctacctataagcacgcaaccgccttctcttcagagaagctccgcattaacaaattacgtgaaattagaaggtacgcagagttcggcttatgacttagctatccacctacatcaagaacatcctgatttattttcgtattcgctacctaaggaccatggacatgctaccacagtgttgaatctgccacttttagagacgttcgctctaaaagtgacacccccgaaaactattttttccttctcatctacaaaattcctattggacactcacaaagactcgcaatcgatcccatattccaaactcccgatttcaaaacaacagcttcctctgggagaaaaaacaggaattcttatacacaaaattttagaatctattcaattttctctattacaagacactgagtacttgatgtctacgatcatgcgtttcataaaacacactcatcttgaaggattcgaggaaacgattcttaaactacttagtaagacgtttttttctcctttaacattttcatcgcagacattttctctatctcaagttctaccgaataagatatttcgagagacttcttttttatttttagagaaccaagagctgtggcaaggggtgattgatcttttttttgagcatgaaggaaagtactacattattgactggaaaacatcgtttttaggagagacaaactccgattactcaaaaagcaacctatctatctacataaaacaagaaaaattagattaccaaggcaggatctacgtcaaagctgtcaggaagtttttaaatcaatttgaaattgatgatgatgtagagcttggagttatctttatccgtggcatagacacccaaggaaatgggtttttcgctttaaatagcagcgaagacattcctaacttcaatcccaaagcaatccaaaaatgtcaggcctatcattaggattaaattctaggggaggtaaaataaagagctgatccagctccataagcttttcttccaaagactgagcttctatcttgaaagtacaggctccatcacgaggagcttttaccttggtgactctagccaccaacagtcctgggggaaataccccatctaatcctgttgtcactaagatatctccaggtagcagagtttttccctcgctaaagtagaatccttctccctctaaacataaagacccttctttccataaagccccacccactccagaaagtattcctcttaggagagcttggttttctccttctccctgtattaaagaatctaactcttgtagctgagagattttttcatacttatccttttcaaggatataggcgtgtgaaatctgctctacttgtctgattagttctctaagactgtgttttatccaccaagactgaatatcaccgcgcatagcaactacagagggcttcattcctacatctgtgattaatcgtatacgggattggtgttctccaacataatcgacaagtcctactagaacatttccagaaagcaccggagaatttttcttgattccatgagtttttcctacattcacccaacaagaactagaccaatgtgtgtaatctcgatagacaacctttccctctaccaacttatgaaaatagggagttaagatctctggaaataaaggaggagtgtgattagagacctcataaagtttgagtttctcttctaaagaagccaccctctccttaagaacgaggttctctaattctaaattagcaagatgagaagaaggagcttgtttaattttagggaaaaatttgacgtgtagagagacaaaactgcttctgatcttatcatagacctcttgagggatgcttcgaaaagagagaatccctaaagcaataataatatagacgcagatttttgtttttttattgcgtaggctatagctcataagcttgaataaaactttgcactacatgatctatatttttttccgtaattccatttaaattcattcttcctcccgctgttgtataaacagcgtgttgttctcttaaaaagagcacctgtttatcggaaaacccagggtatgcaaagaatccatgttgggacaataaaaagtcaaatgtatgaccggcaaccttacgcaaagcttgaacaaatcttgttctcattttacccaaagactctcttataaaattgagttctgattgccattcttctttcaaatatggattactcaaaattgtagaaacaatttctacaccccaacgttgtggtgaagagtattcccctcgaattttttcttctaagaaactgtgaattttaaccaactcatcagtaaaagtactgtgaacagcaaaatatcctacacgctcaccataaagagcaaagtttttgcttgatgaagcagcgacaagaaccgtatttccctctgatataaaaatttctataggttttctatccaactctatgccgtgagcaaaaccttggtatgcggtatcaaaaaatggaattaactctctttctttcattaagatggcgagttctttccacatatcttcagtaaaatctacacctgtagggttgtgacaacaaccatgcaataagataacggaattcttttctacttccttcaaaaatgcgatcaggggttcaaataacagctgtttttgttctttgctataataaggatatcggattacctcaagaccctcttgagagaaaatgcgtatatgattgctccaagtctgctcgggaacataaaccttaccagatccttttgccacggaaagaagccgggctcccaagtgtagcgctcctgtacctcctaaagactgaaacccgactatagcactcggatctacagcaccaaaaaccagctcacgcatctcatctaaaaatatttgcaaccctgaaataggaagataactcttattttgttcttcttccaaaatgacagtttgtgccttacgtatacaagacaagccgccgtaacgcttttgcggatgctcataaacaccaatcacaaggttaaccttttcgggacgcttatctgcaaagaaaacgttctgcaaacctaaaatagcatccggagaaaatgttggtatgtgattaaaaaaactcatatatgactacacctaattataacaaagattgattctaaaccctggaacatgatacttttttgtatcttttggggtattagctcagttggtagagcgcaacaatggcattgttgaggtcagcggttcgaccccgctatgctccatgttcttcccaaatggattgtatccgagaaatcttatactcctttccttgcagtattaccacgtcattcaacttcttccctaacatgttctgcgcaagcttggattgtaaagaaagtatacaactatctggatcggcatcccaaggtcctaaaattgtatactccacaacctctccagcatccccttttaaagtaactttacagccaacaccaactttatctgtaaagacaaggtcttttgtaagaattctcgcccgattaatttcttccgatagcacgcgaatttcttcttgtaagcgagctctcttctctaaagcaaacttgtactcagaattttcccgcaaatcccctaaagaacgagcatcttcaatttccttagcattatcaaccatctccttgccaacaagagattgtagcttggctttcattcttgaaaaactctcagaagtcgaccataaaacattttcttcttctacattagacttgtgcttttttagcgttggctgaacaacttcagcaaggctttgtaaaacgttcaaatcagaagaagaaaactgcgggcatttggtggatagtaatagtaattcttttaaaaagggaagggatgcgccttctatcatctgacgcacagcgagatacctttgccccaccaagtagtggtgtaacttttttcccagttctttatgaggtgtagaggctacttgatacataaaattcaaagctgactctaagaacaatcttaagacttccttgtcttcaggatcaaagagaccatcttcatggttcccaagcttcaagaaaaaccaaacaaacagctcagggaacatcattggttgatgggcactatctagaagtcttttctttaaaacctctacgcttgatggatcgtttttaatggttttatatacaaaatccctcatggttggagaggtggtataaagaagaatttgcataaaaacttgttgccagaaggaagagtactttcttaccaaagacaaaaaggacttttgcaaagcaacaataggcatgttttccaaaagacgactggtatcatcttctgataaggatgttatatactctttgtctatgctcgcatccttaattcccaaatactcagaaagaagcagttctctctgcaaaattaaagacttattaccttcctcaacatcaagatcttgcaaagctttaactagactcttgcgaatctctatatttttcaattcactatgcaaatctctaataaaatgatagatcagagagatcttttctgcgctattgagactcaatcccaacttacgctccaactgtcccatatgagaacaccctgcatcagataaaacatagggctctttaggattgtctggggatataattctagttccctttttaatcttagtcttagctgattgccaccaccgattccaatctgcctcaggaatcacaagatcaactaactcgtctttgatttcctttgcggtctttggtccaagatctctaaggagaatctcaacaacttcaatagggttttccttagcaaaagcctcaaacccatcgggatctccaaaccgtcgtgaaaggaagtgatcgccgctcaaaggagttaaacttttaaatgccgtctcgaaagaaatatccttggcactcataattccttcaaactctatcaacaccttctgctgaagaaacgagacccccataacctcgccaacaccccaacccccttgatggaagacaaagtttcccttatgcatatgcatcaaaaaatcaaaacggctgaggctaaactgaaaatcacgaccatcacgaagcccaacaacacgcaaagcctcgttaaagttttcttctccactgtactttttattcacatattcagtggctatatcaaaaaacatctggctgttagatgtttgcaaatctaaaattaattgaagaactcgatctttatcctttccctcgggtattttttcccaaagaggaacgacggtatccacaatctttccaaataaagatgctaaagaggaagactttactttttctaggatctcaacaagctcccgcccccgcactacatcgttaaaacaatactcctcccaaaggcttaaaaagttcgcagattggccttcttctattaagacttgcaacttttctaaatagtccacgatgtctccagtttttaacctaaaaatatactcttacgtatgaaaaagagcaatatcacaatacaaaataatcaaacttattttataataaactaaaatgatggtgattgttatgaatagtaaatctgcgcaaaaaataatagattctataaaacaaatcctaactatttataatatagacttcgatccctcctttggatcctcgttatcttcagattctgatgcagattacgaatatctaatcacaaaaactcaagaaaaaatccaagagctagacaaaagagctcaagagattctaacacagacaggaatgtccaaagaacagatggaagtctttgcaaataatccagataacttctctccagaagagtggctggccttagaaaaagtccgttcttcttgcgatgagtatcgaaaagagacagaaaatttaatcaacgaaattaccctagatttacatcccacaaaagaatcaaaacgcccaaaacaaaaattgtcatctaccaaaaaaaataagaaaaaaaactggattcctctataaaatcacttataatcccgattgaatgaaacacccaaggacagagtccaagggacttcccttttaaatttttatgaaaattacagtcaatcggggtttagatttatccttacaagggtctcccaaagaatctggtttctataacaaaatcgatccagaattcgtatctatagacttaaggccattccaacctttatctcttaaacttaaggtagagcaaggagatgcggtctgttcaggagctcctatagcagaatacaagcactttcctaacacctacattacctctcacgtttcaggagtagttaccgctatacgacgtggaaataaacgttctcttttagatgtcatcattaagaaaactcctggtcctacatctacagaatatacgtatgatctccaaactctctcacgttcagatctttccgaaatctttaaggaaaatgggctctttgcattaatcaaacaacgtccttttgatattcccgcaattccaacacaaactccgagagatgttttcatcaatttagctgacaatcgtccttttactccaagcccagaaaaacatctggctctcttttcctctagagaagaaggattttatgtatttgtggtaggagttcgagctatagctaaactttttggactccgtcctcatatagttttcagagatcgtttaactctacctacgcaagaactaaagacaattgctcaccttcataccgtttcgggaccattcccctctggatctccatcgatacatattcacagcgtagcccctattaccaatgagaaagaagtggtattcacactgtcatttcaagatgtccttactattggccatcttttcttaaagggaagaattctgcacgagcaagtcacagcacttgctggtactgcactaaaaagttctctaagacgctatgtgattactacaaaaggagctagcttctctagtttaatcaatcttaatgacatctcggataacgatacattaattagcggagatcccttaacaggaaggctatgcaaaaaggaagaggaaccctttttaggatttcgagaccattcaatttcagtcttacacaacccaacaaaacgggagttgtttagctttttaagaattgggtttaacaaaccgacatttacaaaaacctatctctcaggatttttcaagaaaaagcgtacctatacgaatccagatactaacctccacggagaaactcggccgattattgatactgacatctatgataaagttatgccgatgagaattcctgtagttcctctgattaaagctgtaattactaaaaattttgatttagctaatgaactagggtttttagaggtttgtggtgaagatttcgccttacccactcttatagatccatctaaaacagaaatgcttaccatagtcaaggaatccttaatagagtacgccaaggaatcagggatcctaactccccatcaagattgattttttgttcttcaaagaacttaaaattcaaatccctgatgcagtaattccaaaataaaaggagcggagtaactaataatcatatctgcgccagctctcttgattgctatcaaagactcatgaaatagtgtttctttatctaaccaaccttgttgaaaggctgataagatcatagcgtattccccactgacctgatacgcagctagaggcaaacaggtattttgtcgaatccgatagatcacatcaagatagagtcctgcaggcttcaccattaagatatctgctccctcctcctcgtctaaagaagattcaagcaatgcctctaatacgtttttagggttcatctgatactgttttttatctcctgaagttacgtgagaactcagcgcatcacgaaaaggagaatacaaacaagaagcgtactttacactataagacattatagaggtctttgagtagccagactggtctaacttagagcgaatgtagccaatccttccatccatcatatcactcggagctacgatatccgctcccatttcagcatgtaaagttgcaatatttccaaaaattctaacactttcatcattaaggacctctccattaaggaaaatcccatcatgaccgtgtgtcgtataaggatctaaagctatatcactaatcagacataggtgaggaaatgcgttttttatttcatgaatgctatgacataagatgtttttaggatttgaggagtaagaaccgtaagcatctttaagatcatcaggaataatgggaaacagcattacagctcgtaacccgtaggtacacaaacgctctatttcctttaatagcaaatccaaactccatcggaacactccaggaagactcgggatctcttcctttatgttatttccatacttcacaaagaatggtgctatgagatcttttgggcttaagtgagtttcggccaacaaatctcttatagctgctgtctttcggtttcttctaggacgtctacttagtgttaaagaactcatttctcagatcctttcaacagtttccacaggtcctaaatatatattgttatatttatacataatattctcttcttctttagggggtgtggaaactgtttaaaactttgtttttcgagggaagtttatgtggttttgttgttcaaaactttgttaaaacattgttcattttgttgataagtgaggattttgcatgtttataaacacaagatcaaccctttttctacatcaatttttcaaagaaaaataggatgagggaatttttgttagttgtgtagaaactgtgatcttttggctttgatttggataaaaaatttctgttttctctctgttttttgtatgcaataggttgtagaattacaaaaatttctcttgtgatttcggaggtttgaggtgaaattttttcaccgatacttggttacaaaaaccataagctaaagtatgcttggggtcataagcgacgttatacgtcgtactcccctgtagggatgaggcgcgccaatcgtcgaagcaggaatccacttaagcaagtttatattatccgagtatattagtagttttcgggaagatgtccgttcagttttgaggttttcatgttgggcaaagaagaagagtttacgtgtaaacaaaagcagtgtttgtcacattttgttaccaatctgacgtccgatgtatttgctttaaaaaatcttccagaagtcgttaagggagctttattttctaaatactcccgttcagttttaggtttgcgagcacttttgttaaaagaatttctatctaatgaagaggatggagatgtttgtgacgaagcctatgacttcgaaaccgatgtacagaaagctgcggacttttaccaaagggttcttgataattttggggatgattctgtaggagagcttggcggagcccacctggctatggaaaatgtctctattttggctgctaaagttttagaggatgctcgaattggcggatccccgctagaaaagtccacaagatacgtctatttcgatcaaaaggtacggggggagtatttatattaccgagaccctattttgatgacttcggcctttaaagacatgtttttgggtacttgtgattttttattcgatacctattctgctttaatccctcaagttcgtgcctattttgaaaaactgtatcctaaagattctaaaacacccgcatctgcctatgccacatcattacgagctaaagttttagattgtatacggggacttcttcctgcggcaactttgacaaatctaggatttttcggtaacggtaggttttggcaaaatctgattcacaagttacaaggtcataaccttgcagagttgcgacgtttaggagatgaatccctaacagagcttatgaaagttattccttcatttgtaagtagagccgagcctcatcatcaccatcatcaagctatgatgcaatatcgaagagctttaaaagagcagctcaagggacttgctgaacaagcaacatttagtgaggagatgtcttcttcaccgagtgttcagttggtatacggagaccctgatggcatttataaagtagctgctggatttctttttccttattcaaatcgttctcttacagatctcatagactattgtaaaaaaatgcctcatgaagatcttgtacagattttagagagcagtgtttctgcaagagaaaaccgccggcataagtctcctcgtggtttagaatgcgtagaatttggctttgatatacttgctgatttcggtgcataccgcgatttgcaacgacatcggacgctgactcaagaacgacagttactctctacacatcatggatacaattttcctgtggagcttctagatactcctatggaaaaatcttatcgagaagctatggagagggcgaatgaaacctataatgagattgttcaggagttccctgaggaagctcagtatatggttcccatggcttacaatatacgttggtttttccatgtaaatgctcgggctttgcaatggatttgtgagttacgctcacagcctcaaggtcatcaaaattaccgcactatagctacaggtttagtgcgagaggttgtcaagttcaatcctatgtacgaattatttttcaaatttgtagattattctgacatagatttaggacggttaaatcaggaaatgcgaaaagaaccaacgacctaagtctctagatctgtaattttagatattgtaaaaacataatctttgcatttacaggaacattctctactggtatttttattcttttttcatgaagagatcataaaatgaaagatcttatatataataacttggttaggtttaaaaacatttctaaaaccaaaacttcaaggtaaagggtgtcaaaggaggagcctcatttacagcttctatagctgtagatatagactctgcggatttatcttccgaggattctatggaggttattatagaaaaatgtgctcagattggcgttgctgaattccaaaaatgcgaattccaatttgagggtattacctgtttgtagaaatctagtttcctgggtgtagcgcagcctggtagcgcacttgcatggggtgcaagggggcggaggttcaaatcctctcatccagatctctctcggggatgaagattttatcttcatcccttttttataagaaattttgttagtaaagatagaagccaaggtggctgtaagtttaaaatagcaccttagaatatccttgaagatttaaaaagatcctaaactcgagataatcgtttcgaattcagaactattctttaatccaccagcactgagacgatccaagagctctaagcaattgttttgagatcttgctaatagctctagagcggccttttctccaaatagtaaagcataatttagcccaatttgttgggagtctttttgtaaatctgaaaaatcatcttttatttgaaaaagtaagccaaaattatttgagaaacttgtaattataggtgcaaattgtgggtctccgccaccaaataaccaaccagaaatacatgcaatctcaaatagagaacccgtttttttgatcataatagattgtacgtgttcttgacctcggttagaaaagaacatatcatcatactgccctcctaataccccagaacatccaatatttttgtctgtaatatctccgataatgttgtaagcgatatctatttctctaggatcacagccctgttcttttaacttctttgcgtttaagcgaaggtgggagtaagcagcaggaattagggcgtaagatgcgagtaaggcggttgcttcatcgaaagctttatgtaccgtcgggcgtcccctacgctcatcgtcgttgtccatgcaaggaagatcgtccgcaattagggtggaagtgtggacaaactctacagctaaagctgagtccataacgtcatgatttaagcccaaaccttgagccatcatgcagactaaaccaggtcttaaacgctttccaccgccctgtaaagcgtattctacaggagagcgaatcgggtgacctataggaccaaatccttccaaagccttttctatagcactttctatagaaggtcgatacgtatctaaagcatgtaacacaagagtcccctatttttaaatgacttgaccaggacgaattctagtatgagggagaatatgttggcctggattgatgacaacattgcatcctatagcaaccccttttcctaaaaaggcaccaagtttacgacgccctgtatcgattttttttgatttatctgaggtagaacgaacatagatgttccttccatctagacggaaattagcacaacgtactccagcacctagattgacttctgaacttaacacagaatctccgaggtaagcaaagtgagcggctttcgtatgatgacctaaatagctattcttgatttcagtacagtgacccacaacacagcgactgcctgtgatgacattgcctcgcagataggccccatgacgaacttctgtttgtgagccaagaatgcatggtcctacaatgtaagccccagactctacgtaggcatcttcagcaatctcaatcttttctatattttttaaagttacaccagactctacagtaccatgaatcccagaaaacacgtggttttccagcatctgatccattaaatcaagaatatcccaggtatagtgagctttggagattatctcaggatagagaaagtcctcaggagaaaatatagacgaggctagataagtcatatagcatactcaagctatttgcctcagtattttcatactctgaagatttacttacaagatataaagaacttactttactcttcgtttggatgcgctgtattgtcatgattctggagaggaatactgtcatcatctgaaaatagatagcctacaccacgaatcgttacaattttagatccgtagggacctaatttttttcttaaagaagcaatatggacatccacgttgcgagcaatgatttctttagtatttcctttaatctctgctaaaagattctttcggagacataggtgtccacggttgataaggagttttttaagaatacctgcttcagaaggggtaaggtatacgcttccttctggagattctatcacgagattcaagactcggaatgtatgatctccaaaagtcattgtatctggaatgctatgctctagaacttcgtgttggcgtaggaaagctctgatcacggcatctaatactttcgctgtaataggacggagaagataccctgttgctccttgatttaacacctttgtgatcgcctcttcttgaaatgtatcgaatagaacaattaaatcttcttctggaaagatcccaggagagaaaatttgctcaggtagcaataggtattcacaaaatatagcaacagattcaaaagatgtcggaaacaccggagatacgagtatttggtaatcagatctttgtgatgccaagtcttttaattgcgaagataaactgagatcctcagtaacaaacaatatgattttatcaccgatcatatgaaaacaaaatagattatatgaatgaatacgtaatataaaatcagttatttttcaaaggtcacttacacttttttacttttttcttttttgaaaaatagttttgcataaacacaacactatatatataatttaaaattaataatttagaagcgacatagttttttaacttctttgaaggccgttcaggacgtaaatgtttcgttgcatattgtttggtattttcctactcacgtgtttttcttctggcggggtgttatattacttattctgttcccatgatttttctatagggcctaaggaaaaatcacgatccgtgtggattgaggaagaaaaagagttcacggattccgtattacatcatctgccatcgcaacatcagcatttgcatattctttgtttccaagggtttttactacagaagcaacaaaagttttctcaagcagaaaagattttctctaaagtttacgacgaggctcaggacggtccttttctttttaaggaggaaattttaggatcccgactgatcaacagtttttttttagaaaaaacagacgtcatggagaccattctttgtcttctgaatcagcgctgtcccaactccccttactaccacttatttaaggctctagtatgctataagcaaaagctataccgtgaggtcatagagcaactagcctactggcaagaagagaaaactcgagcgcttgctcctttattgaatataagtattgaacagctgctaacagattttctgttagattatatttctgcgcattctctgatagaacagaaaatgttccccgaaggcagagtaattcttaatcgcaatatcaataggttattaaaacacgaatgtgagtggaatgcgaagacatacgatcgtattgcgattcttcttagccggagttattttctagagttggtagaatctaagtctgcagatatttattttgattattatgagatggtgcttttctatctcaaaaagatctatattttagagcagtgtccttatgcagaacttctccccgaggaagagcttgtttccttgattatggaacacgtgtttatccttcctaaagataaattatatcctttaattcagctcctagagatgtggcagaagcattatgttcacccaaatagttctttagtagttcagatattggtagaccgcttttctacacatatggaaggggctattcggttttgtgaggctttagtttctttctctggattggaagaattacatcagcaaattattaccacttttgaagagctgctttcaaataaagtacagcagataaaaactgaagaggctaaacaatgtgttgccctacttcatattttggatccttctatttccattagtgaaaaattagctctttcttcggatacattacaaaatatagtttctggggacgacgagcagcatacaaaactccgcaattacctagatctttgggaagccatacagtcttatgatattgatcgccaacagctcgttcatcacttagtttatggtgcaaaagatctttggaaaaaaggaggaaatgatgaaaaggcattgaaccttcttcagctggtcttgaggtttacaagctacgatatagaatgcgaaagtgttgtgtttctttttataaaacaggcgtataagcaagcactgtcttcccatgccattgctcgtcttttaaagttagaaaaatttatatcggaagcgaatattccctctatagtgattagtgaggctgagaaggccaatttcttagcagatgctgaatatctttttgctcatgaagactatgacaaatgctatttgtatagcatgtggttgactaaggtggccccctcccctcaatcctatcgcttagcagggttatgcctgatggaaaataagcgttacgacgaagctttagaatttctctgtatgctctcacccaatgatagtatcaacgactataagacgcagaaggcattagcattttgccaaaaacatcaatctaaggaccgagctgcctcttagcattctccccccatcttttcactcttaaagtaaagagtttttgtgtagtaaattttttatagttttgcttaggaactattctccgagtgtttaggaaaagattttcgaatcttcatgcattcatgttatgttagactctataacggaatcaaagtagggatgggcattgcacacagaatttgctccttttttagaagacttagtacatcagcaggtgatatcccctttagacatcgcttttgcttctaagcacatctcttcggactttgaagagtcttttgtttttctcgcggtctcctcagcgctttggcgttatggtcatccttttctttcccttgaggaaaatcgcattagaccttctctaggagggatctcagaaacagatttgtatcggggatttcataaccttcctaaggaagctcgagataaattatttgtcgttgtttcaggacgtttgtatttacggtctctgtatacgatacgatcgaaactcttagacaagctttcgttgctttgttcagcaaccccgaattattttcctccttctatagattcttcgatcctttcagaagagcaaaactttatttttaataaaataactcaaggatgtttttctatagtttctggaggcccaggaacaggaaaaacttttttagctgcacaactcatcctctctttagtgaagcagcaacctaagttacgtattgctatagtatctcctacaggaaaggccacgtctcatattcgtcagattcttatgaaatataatatatttgacgacatggtgttgatgcagacggtgcaccactttcttcaggagtatgcgtaccgtcgctataactctatagatgtccttttagtagatgaaggctctatggtaacttttgacttgttgtatagtttggtacaaaccctacagggatatgagaaagacaaaaaactttatacctcgagtttaattattctcggagataccaatcaattgcctcctattggcattggggttggaaatccccttcaagatctcataggatatttccatgaaaatacgtttttcctgaagacatcgcatagggcaaagactggagttgtggatcagctgactcaatctgtattgcgtggcgaaatgatttctttttctcctctcccatcgatatcctcagctatagaagtcttgaaaaatcgttttgtaaagtcgttacgtcaatcagaagcacgtttgtgtgtattgactcctatgcgccatggcccttggggggttctgaacttaaacacaatgatacatcaaagattggcgagaagcgatcctgatttacgtattcctattatggtgacgagtcgttatgaaacttggggactatttaatggagacacaggattactgtgtttaaaaactcagaaattgcatttccctcaacatgaacccatagattctagggctctatcacaatacgtctacaattacgttatgtctgtacacaagagccaggggagtgaatacgatgaggttattgtaattattcccaagggaagcgaagtgtttggggtgtctattctctatactgcaattacccgagctaaatatagagtttcagtttggggagatcccgagacgttacataagataattaagaagtctaattactagattcttatcaaaataaaaaaaccctcaaagaatactctaagagggtttttttgctgcgaatgtcgttaaaaactatcctattttagcataatctttaacaaagtttatgacacagctaatcaatccaagaatagccataattagaacagcatggactccaagaatagcaggaaggaatagagaaagagtgccaagagcatcacaaactaaatcaactacatctccaagccatgcaatgaaggcgtttcttatagctttggaacgtgctgcgaattcggcagaaggcttgtttctgttttcggggtcggagattgtttcaggcctggtgcttaaaattctgtaaagtgaaattgaactctcagttaaagagcatcctgtagccactaagtttaggcaggaagtcaccttacatccaattttgtttgcattggctcctaaggaaaccacgtccatttcatgtaagaatgtagctgttccaagagtctttgatgctaaacgagcaacttttcctgtgatagttagggctgatcgtcgttgtagtttttgagtcatacaaccctcagcatctgcttcgttgcaacgtctgagttctcctgtttcctcatcagtttcgaagatcatagaaccattaagtagttggccccacaacatagctcctgccactgcagtgttcactccgtcagcggcacccagaaacccttcagttttctgcaaagcagcatgtgcataatgggagcttcctaaagcatgtctagagattgctgtggaatttttaattgctccgacgatgtcgccggcaaacaaaacgttattgtgtagagacattgattgctgtctgaataaattgcctgaagctctgattgccggagtccaagatcttaaatgcagaagtgcttgtctaccaagatgtgctgttgccataatctacctaattattagattgttttaaggtcacgatgctctcgcgttaacttttaaggttgctttagatttaatgcgtgctgccttattatctttgaagatacctcgctttacagccttatctacaacactgtagacggattgtaagttgctaagagtggcttgagtgtcgtcgagttttaaagatgcttcaaactttttgactattgttttcactttagatttgaagctgtgattgattaactctcttttttgagcagttagaatgcgtttttcagcagaaggtcttctttgtataacgttttttttattcggttttttaggtgccataatatctccagacaagacaagaactttaagatttaaaataaactgctattaattgcagatcaattgagagagaaaggaaagctttttcttattttcgatacacatattaagaaaaaagagaatttatgagaaataaaaaaagttttatgccaacataacaataagaatggtcttaaaaaaatacttttctaatcaaatagaacttatggctatgaagagcaatttattcttatttttgttgatataaggatttattttttatgttattggtaaggaaatggttgcatacttgtttcaaatattggatttactttcttccggtggtaacgctacttcttcccctagtgtgttacccttttctgtcgattagtcaaaaaatttatggatactttgtttttactacaatttcttctttaggctggttttttgcattgagacgtagggaaaatcaattaaaaacagcagctgttcagcttcttcaaacaaaaattagaaaattaacagaaaataatgaagggttaagacaaattcgagaatctcttaaagaacatcagcaagagagtgctcaactgcaaattcaaagtcagaagcttaaaaacagcctatttcatcttcagggtttacttgtgaaaactaagggagaggggcaaaaattagaaactttgttacttcatagaacagaagagaatcgatgtttgaaaatgcaagtagattctttaattcaggaatgcggagaaaaaacagaggaagtacaaactttaaatcgagagttggctgagactttagcctaccagcaagctttaaatgacgagtatcaagcgaccttctctgagcaacgcaatatgctggataagcggcagatctacattggaaagctggaaaacaaggttcaggatttaatgtatgagatccgtaacttgcttcagttagagtcagacatagcagagaatattccttctcaagaatcgaatgctgttacgggaaatatttctttacaattgtctagtgagttaaaaaaaattgcttttaaggctgaaaacatagaggcagcctcttctttaacagcatcacgttaccttcatacagatacgagtgtgcataactactctttagagtgtcgccagttatttgatagcttaagagaagaaaatctcgggatgctttttgtctatgctcgtcaatcccaacgtgcggtttttgctaatgcgttatttaaaacgtggacggggtattgtgcagaagattttttaaaatttggtagtgacatagtgatttctgggggcaaacagtggatggaggatcttcattcctctagagaagaatgctctggtagattagtgattaaaacgaaatcacgaggtcatcttcctttccgttattgtttaatggctttgaataaaggccctctttgctatcatgttttgggggttctttatcctctccataaagaagtgcttcagagttgatactatttcttcttctatgaggaaagttgtatcaaattgttggtaagatattgattttcgtcagcgtataagataaaaatccctagatttcctatcttcctttgactaaactgtcctctaaggctagaaatccccttgttttattccaagtaagaaagttgttcatgaatacacagaatagccaagctacagaagtttcatcagaagaagaatctcaaaagaagttagaagagcttgttgctcttgctaaggaacagggtttcatcacatacgaagaaatcaatgaaattcttcctatgtccttcgacactccggagcaaattgaccaagtgttgattttcttaactggaatggacattcaagttttgaatcaaattgatgttgaaaggcagaaagagaagaaaaaagaagctaaagagcttgagggtttagctaggaggactgaagggactcctgacgatcctgttcggatgtatttgaaagaaatgggtacagtacctctccttactagggaagaagaggtagaaatttctaagagaatagaaaaagctcaagtacagattgaaagaatcattttacgcttccgttattctgctaaagaagcgatttctatagcccactatttgattagcggcaaggaacgttttgataagattatttccgagaaagaagtagaggataagactcactttcttaagttacttcccaagctaattaccttgcttaaggaagaagatacgtatttagaaaacttattattgtctttaaaacagcctgatttatccaagcaagaagcagctaaattaaatgacagtttagagaagtgtcgtattcggacgcaagcctacttgcgttgtttccattgtcgtcataatgtcactgaagattttggcgaagttgttttcaaggcttatgattctttcttacacttagaacagcaaattaatgatttgaaagttcgtgcagaaagaaataagtttgctgctgcaaagttggcagcagctaagcgtaagttgtataaaagagaagttgctgctggaaggactttagaagagttcaagaaagatgtacgtatgttacagcggtggatggataagagccaagaagccaaaaaagaaatggtggagtccaatttacgtctagtgatttctatagccaaaaagtataccaaccgtgggctttccttcttagatttaattcaagaagggaatatgggcttgatgaaggctgtcgagaagtttgagtatcgccgtggttataagttctcgacgtatgccacctggtggattcgtcaagctgtgactcgtgctattgcggatcaggcaagaacgatccgtattccagtccatatgattgaaaccatcaataaagttcttcgtggagcgaagaaattaatgatggaaacaggaaaagagcccactcctgaagagttagcagaagagttaggattaactcctgaccgtgttcgggaaatttataagattgctcagcaccccatctctctacaagccgaggttggagagggtagtgaaagttcctttggggatttcttggaggatactgccgtagagtctcccgcagaggctacggggtattctatgcttaaagacaagatgaaagaggtcttaaagacgcttacggatcgtgagcgatttgttttgatccatcgttttggccttcttgatggcaaacctaagactttagaagaagtgggttctgcctttaatgttactcgtgagcgtattcgtcagattgaagccaaagctttaaggaagatgcgtcatcctattcgatcgaaacaattgagagcattcttagacttattagaggaagaaaaaaccggaactagcaaagttaagagtttgaaatccaaatagtctttgagtaaaaggttcgttttttatagccttgtataaaaaatattgctctggtgattgctatagaacgttatcagttaattatatccaagtttcgtatgtggttgtttttagggtgttctgttgaagagcgtcattttaagcagcctgttcttatttcagtgactttttcttataacgaagtcccgtctgcttgtttatccgacaagctttcagatgcttgttgttatctagaggtcacctctcttattgaagagattgcgaatacaaagccttatgctttaatagagcacctggctaacgagctatttgatagcttagtgatatcttttggagataaagcctccaagatagatctagaggtagaaaaagaacggccacctgttcccaacctattaaatcctataaaatttacaattagtaaagagctatgtccgagccccgttttgtctgcttaagtttaggatcaaatttaggaaatcgttttaaaaatctacagattgctcgtactttattaggcgaacaagctgttttaggtctacgtagttcggtaattctagaaacagaagccttgttattaccgggatctcctccagagtgggaccttccttattttaattcggtacttgtaggggaaaccaccctatctttgcgagaactactggttactatcaaacagatagagaaggtggtaggtagagcagaggagtcgcccccatggtctcctcgaaccatagatgtagatattttgctttatggtgacgagtctttttgttgtgatcacaccgagataacgattcctttgtccaatttgttatcacgtccttttttgattgctttaatagcatctctttgtccttatcgtcgattttgcactcaaggttctccttatcacaactttacatttggagagttggcgcatcaccttccctcacctccagggatgattcgtaggagtttatctccagatacgatgttgatgggggtggtaaatgtgactaacgactctatgtctgatgggggcatgtttttagatccagaaaaagcagtggctcaagctgagaagttatttacagagggcgctgcagttatagattttggagctcaagcaacaaaccctaaagtaaagcagtttttatctgtagatcaagaatgggagcgtctggagcctgttttaaggttgttaaaagagacttggtccaatagaaaacaatatccaatcatctctttagatacgttttatcctgaaattattcttagggctatggatatttatccgatccagtggattaatgatgtctctgggggatcacagtctatggctgaggtcgctagggattgtgagctatccttggttatgaatcactcgtcttcgcttcctgtggatcctaaaaatatcttgtcgttttctgtccctattggagagcaactgttgagctggggtgagaagcaacttaagatgttttctgatgttggtctgaacgcaaatcaggtgatttttgatcccggtataggttttgggaagggggctgcgcaatctttggctactttgtatgagattgcgaaatttaagcgtttgggatgccctatccttattggacattctcgaaaatcgttcttatctttatttggtaatcatgatcccaaggatcgtgattgggaaaccgtaggtctatctatactcttacaacaacaaggtgtggactacttgcgagtgcataatgttgctgctcatcaaaaagctttatcagtagctgcttgtgaagcctgtgcacccatctaattttgaaaatcctctaggtgtcgagatgtgtaaaaatagaggggtccgcgggatcgtggcttgtgatcctagaggggtgataggtttagaaggaaagcttccttggcattaccctgaagatctccaatttttttctgaaaccatacaaaaatttcctattgttatgggaagaaagacttgggaaacacttcctaggaagtattttgttgatagagcagtcgtcgtgttttctcatgaaaaacgacagggagtgcacggggagatctgggtaacttctttagaagaattcctgctcttagatctttcttcgccgacatttttaatcggtggtggtgagctttattctcttttcttagaaaatcaaattgttcgagatttttttatttctcatatcaaaaaagaatatgctggtgatacatttttccctttgtccttgctagagacatggaccaaaactgtgcttagagatacccaaaagatcacaacgtgttactatgaaaatcaccacagtcaaaacaccaaaaatatatccttatgatgacctatattctattctagagtcttcattgcctaagttaaacgaacgctctattgttgtgattacgtctaagatagtctctttatgtgaaggtgctgttgtagaacttgagaaggtttctaaagatgaattaataaagcaagaagcagatgcctatgtttttgtagagaaatacggcatatatctaactaagaagtgggggatactcattccttcagcggggattgacgagtccaatgttgaaggttattttgtgttgtatcctagggattttttgctttccgtgaatactctaggggattggttaaggaatttctatcatctcgagcattgcggaatcattatatcggatagtcatacgactccgttgcgtcggggaactatgggtttaggcttatgttggaatggttttttccctttatataattatgtaggaaaaccagattgttttggtcgtgctttgaagatgacttatagcaatttattagatggtttatcggcagctgcggttctttgtatgggagagggagacgagcagactcccattgctattatagaggaagctcccaagattaccttccattcttctccaactacattacaagatatgagcactttagcaatcgctgaggatgaagatttatatggtcctctgctacaatctatggcatgggaaactcccgcaccaacctcctgaggtattatgacatcctggatagaattacttgataagcaaattgaagatcaacatatgttaaagcacgaattttatcagcgttggtctgaaggaaagttagaaaaacaacaacttcaagcttatgccaaagattactatttacatattaaagcatttccttgttacctttcagcgctgcatgctcgctgtgatgacttgcagattcgtagacaaattcttgagaatctcatggatgaagaagctggaaatcctaatcacatagatttatggagacagtttgctttatctcttggagtttctgaagaggagcttgccaatcatgaattcagtcaggctgctcaagatatggtagcgacatttcgccgcttatgcgacatgccacaacttgccgtgggtttaggcgctctctatacttatgagattcagattcctcaagtctgtgtagagaaaatccgtggtttgaaagaatattttggagtttctgctcgaggctatgcatactttactgtacatcaagaagctgatattaaacatgccagcgaagagaaagaaatgctacaaactttggtaggcagagagaatcctgatgctgttttgcaaggatcacaagaagttttagatactctatggaactttttgagctcttttattaattcaacggagccttgttcttgtaagtagtatcttggcaggtctagaatttttggatcttattagcttaaaaaataggatcatgcatctgtaaacagaatcccccctcctaaagtattagaaggggggattctttgtctcaaggtaatttgtagaatctctatgttttctatttagaaattacaatttaagcttctactgtttgagcaggaacttcctgaggtgtttcattagcatgaacagagggagttttattcgctgcaattacatcgtagatgcgcttctcaatttcctcaaaaagctttctattacgtttaagttcttcacgaacaaattctcttccctgtcctaacttcttctcttgatagttgaaccaagaaccttttttctcaataatattatattcgacagcaagatctaggatacaacctgcagaagaaatcccttcattgaataggatgtcaaattctgcgattctgaatggaggagcaagtttatttttagctaccttcactttaattcgatttccgatgtcagagttatcactgccttttattgaacctatacggcgaatatctaatcgtattgaagagtagaattttaaggcacgtcctcccgtagtagtttctgggtttccgaagctaacaccgattttctctcggatttggttaatgaacactgcacaggtttggctacgtgatagggtagcggtgagcttgcgtaatgcttgagacatcatacgagcttgtaggcctacgtgtacatcaccgatgtctccttcgagttcgcttttaggaactaaagcggctacagagtcaataacgataacatcgacagctcctgaacgcgcgagcaattctgctatgcttaatgcatcttcaccacagtcgggttgagaaatcataagatcatcgatattgacgccaataagagatgcataactaggatctaaagcatgttcagcatctatataggcagcaacaccgcccattttttgagcattcgcgacaatatgggtagctagtgtcgttttccctgaggattcaggaccaaagatttcgatcacccgtcctttggggaccccatgaattccaagagctaagtctaaagataaagctcctgttttgatggtggagatttcatgtgtggcagagtgtcttcctaaactcatgatggacccagcgccgaattgcttttcaatataagcaacagcagcttctagagccttttttctatcaggtaaattcatgtaaatgctcctcttggtttccatattccccagagaatagttctgtttctctgagaatcgagagaaatagagaagttcttctcatagttagttgagagatttgggggtggaaggttttagatgatgtgtatcattctgtattgttttgctctctatgcatacttgaatttgccatggcagtcaaggcaaaaagtaacttcaagatggcttgttatttctcaataaatttaagaaaagcactagaatacaaggaccttagtttcagatagtatatctaaattatgaaactgaaaaaatagatctattggatgccgagattcctttaacaagggaaactattttcaaaaaatcaaaagaacttcttcttatttctaacataaatagatttgggaaagggggatgtcatgactttcttggggaagtctatcgattttttgttcgcagtagccgatgccgatggttcgtatagagggatagggatgttgtgctaaccagcgatcgtagaaaccgtgaccataaccaagccgatagccctgctgatcaaaggcaaggcccggaacgagcacgtgggtaatcttatcactcgagatcggtgtttgtttcgagaagggatctttgggatgcacaacggaaataagatcgtctatcgaggggataagaacaggatagaggttttcctgatcaatcttgggaagagctagggtacatttctggataagtatgcgatttgcttcttgcatgtctatttcgtgattgaaagagacaaaagagagaacgacgctctctttagaaaagctgcgaacgaaagaggccactgcagaagaggcctcatgcttgcgttcttcagagagatccctgcgtatagagataaatagtttacgtagtgcggatttctctattttaggatcagtcatagggaagttctagttgagcaaaggtttgccgtcctgataggggatttttttagtaatagttcccgccgacgagaaaaatactgcagtcccacaaccacgatctattttagagtagggatgacggtctccagggcggaagtactctcctttaattagaagatcattatcatactcttcggtcgccatgatctgtccttcagggtagtaaatggtcagtaacccggattttttgttatttacgagttctttacaactttctaaggttcctccgggataccaagtttttactatcccatttaaaattccttcatgccaattaagaagcagcttgggtttccctgtctcaggataaaagaaaaattcttctccgtgcttcgcgccttgcaaaaggttatacgtttggacaatctgtgttccggagttgtcgaatctggtaacttttccataaggttcccctcggtaaaatgccctagtttctataacggcatacttgccgtagattgcttgaatgccgttcccttcgtgtatagtcgcatagatttcgtgagtttgaggatctaagtactctgcttttaggagtcgtccctcatgatattcttcccaggctaaaacatcttcttcggaatcttcgctgtagcgaatcgaaagaccgtgtcttttgccttgttggtaattctgttctttgagcagtttccccgaagatgtgtatgtcaggaatttaccttgaggaactcccttatgatagggacactctttccaaatattcccattagtatggtaatacaccgaagatccttcgagcagccctttttcatagacgatagcggcttctaagataccttcatcattataggcaaatgtagtttgatcaaatagccagccagactctgctgagggatgaagatccgcaatacctccgataacctcagcttggattttgatattcccgttgacgtgccattcacgatatcttccataagcacgattattgagacactccaggtactgcttaatttgcccgttagtgtgataggctgttaaacaagaaacgttatctccgcgtttgtttttatacatcctcatgaccttttgatagggctggggagcaagaaagtctaccttggtgtatttctttagcttctctttagagcaaatagtttctgacaggccgtttctatcaatgatattgatccctgtaagggtgagtttctcatagtcacctgttttcccataaatgggactcatggcaattagagaagaacatagaaataagcaaaagagtttttttatatccatcgacttatagcctcagcatgtgttaaccagacctcatttcctagaggcgtagtttgttttgtcattttccaacaggtgaagaaaactaggggcgcgacagggttctctgggttgaaaagagaaaacaaggactcgatatcttcattatccatttcagtagcttgctctagacgcacaaatgcaaagtcattgtgcatttgttcgcagttccagacgagctggtgatttgatttttctagagcacgctttctttcccaaacttctttactttgtgctagcaaagaatttgagtttaatttgtttaaacgttcgcgttctttggatagagggcgtaattgcttgcaagaggcatttaaactttctattgagaggttattgcgatccttagaaatgcgagcattgtgtttgatcacctgatcttcatgatctcttataactttcagtgtgagaatctgagaatttagatcagaccaacgctgagagatcttcacgtgatttatggtaatcgctaggacgggaagtatactcaaaagagaaagaaaactaagaattaaaatagaaatccattttttcataagacgtcctaagagcttaatgtaaattgtagtttaaaagatcgttgatcttctagagactctgaaacatgttgtagcttggggtgactcgatattttttttaagaattgagggatgtcttcaggttgtccttgtcccttgacttcaactaaggcactgtaggggagagaggggttatcttttgagggataacttgtcatggtataggagaaatacgagaactttattgaggggctgcttttcccaagggcaagaagaaattttaatgtttgctcacttgtgggaattgtaggcaagagtgggtagttggaagccgagttcttctttccgattgcctttactgttttttctgcggcctttaaagatcttgggagcacgccctcttcaggacaagcgaaagcaaaatggttcgaagctgaggaagaaagagatttaagttttaacacggatcccagacttacgactaccgtagccatgagggcatacttccctatcaacagagaggagcgtagcagccaatgtttttgggctgctggggaaactgaggtagcgtcatagggaaaagttagaggtcgtcttgaggccccatggtgggcagcagcaatagtatctccataaatttcccaatcctcgtcttccactccataagtcatagattgacagaccacaagcgggagagacagtttttgttctaaaattttttgtagattcggggatatctgtgcgacgtgaatagcaggaagcacagtttgtgggaatgtttcttgtatatactgcaacgttgcatggatgtcgtcgcagctttttttcgttgagtggttgctaaaagaacgagctacagcaatggcatgattttttacaaaaatgcaggtaacttcttcagaaccgccatagataagaagatatgcgggcaggctctttaaagggctctgttctgctagaaaaaaaatatcggcagcacgacaagagagtttatcagggaaaatctgagcctgggacagaaaagaaagttcttttttgagtgtatttttttgagcaatccatagggtcagaggagtttctcctctatccgtcggtttgcctagttgtggctgtacaatcagagattcccagggtagggcaagacttgcttctagatttgtgagagctacttttaaaatattttttctatttttaagggatgaggaagaacttttgactaagatgtcagagccctgcagagagaaagtcgttggtgctgcaaagtatttttttgggagagaccaggtctttccttcgggaatttgttcacagtgacagacgatccatcctttacatgttttctgtaaaattgctattttaatagtattgttttcagctttggttagtccaatatgataaacaggcagcttgaaattcatagctcaagaattcttaaaatataaaggcagctattttaatggatagagggctctttttcaagaaaaacacatattaattataattaagagagtaaaatataatgctatcttatttgttaagaacggctattaatgtttatagctttctaattttagcctatatctttgcttcttgggtccctgattgccagtctgcgcgctggtaccagttggtttccaagtgtgttgacccttttttgaatttctttcgtcgctttgttcctagaattggatttatagatcccagtccttttgttggtctgctttgccttggaatccttccttttgttatattaagagtcctacgttttattattcttaatatttttcattctccatggctgctccaatatttataaaaaatattttacttcgttcctctatagtctatgctcctctagcgggattttcagattatccctaccgttgcatgtccgcattgtatcaaccagggttgatgttttgtgaaatggtgaaagtagaagggatactctacgctcctgagcgtacttcgaagcttctagattataatgagaacatgcgtcccataggagcgcagttgtgcggtagtaatccagaaactagtggggaggccgctaaaattttagaaggccttggtttcgaccttatagacctaaattgtggatgtcctacagataaaatcaccaaagatggcagtgggtcaggtcttttgaagacgccagagcttattgggaggattttagataaaatcatcaatagcgtttccattcctgtaacagtaaaaattcgctcgggttgggatatggaacatatcaacgtagaggatacggtacgtattatacgtgatgctggagctagcgcagtttttgttcacgggagaactcgtgctcagggataccacggtcctagcaagcaagagtatatttctagagccaaggctgctgcaggaaaagaattcccagtttttggtaacggagatattttttctccagaagctgcgcaagcaatgctaactacaggatgtgatggtgttctggtagctcgaggaaccttgggagccccttggattggaaaacaaatccaagactatctcactacaggaagctatgagaaaattccctttatcaaaaggaaagctgcgtttctggagcatatgcgcctagtagaagactattatcaaagcgaaacgaagttcctttcagaaacacgtaaattatgtggccactacctaatttccgcggctaaggtgcgttttcttcgttcgtctctagcaaaagcgacatcctaccaagaagtctaccagcttgtgaatgattacgaagaagccgacgactcgtcattagagacctttgttaaatgctgacttaggtgtttcgaaagttggaacatatcgataggattcggaccaatgatcgtagctaaattgttatcaggaactaaaagttttttattttctggtgcctgtaattgatgttccttgatgtaatcccagatttttttggttgcttctccccgagatacgggttcgtttccgatcatttttgctagatctggagagggaaggaataaaggacctgttttcttttctgaagattttttaaccgagctttttgcttttccctttttagaaggtgttttggctgcttttgttgtttttgctgaagattttttcttggtcggagtttttttcttatagggaattttttctgttcctgagtactttgtgattacagcatctatagaatttccaatcacactacattcaggatactctgaacaggaatagaaaatcttgttgtaacgggagcgttttttgaaaattttcccattacagcctattgcagggcaggggataggctcttcctgttcgatttcctctccctttttatggattgatatagtgccacggcattcaggatacttctcacaccctaaaaatgttccatagcggccgtgacgtactttcataacgcctccacaaagaggacaaggactgtcccagggggtgtcttcagcatagtcttctttgttgaaagcgagctcttcttcagaagtgcggtaatcgcattcaggatattctgagcagccatagaaataactgtttttagaccagatttttactagttttcctttatggcacttagaacattctatatttgtgagaattctaggaatgacagcttctttttctgctgtaatcactacaggaaggaatgtagtccagaattcttgaagtaagagtttccaaggttttttattatctgcaatgagttcaagctcgtcttccatgagagctgtgaacccgatatccataattcttggaaagtttgtttctaagaactgtgagataatctttcctaattctgtaggacgtaaccgttgattttctttagtcgtatattcacgactttgaattttgttcattatcgtggcatacgttgaaggacggccgatcccagatttttctaactctttgactagagaagcttctgtgaatctaggaaggggttttgtaaatgcctgttcttgggatacttcctctttgattaaggcatcttgggcatgtaggggggggagaggatggtcttcttcttgatcattttcatcatcttgcttctcttcatagacagcgagaaaccctttaaattttagtaaggatcctgaagctcggaggtctatttctgtatccgtagtaatttgaacagctaaagtatcataaattgcaggggtaatctgtgaggctacgaagcgtttccagattaagttgtatactttaaattgatcatcagaaagcttattctttaatttgtcaggagtcagattaatatcagtgggacgtatggcttcgtgagcatcttgcgtcatcttttttgtagtatatacgtttgctttctcagggagatattctttaccgaaagtctgttggatgtactctctaactgtagttaatgcttcgggatctacacgtacggaatccgtacgcatgtaggtaatcaaacctgtagaatcttcactatctaaatcgacgccctcatagagggtttgcgctatagacatggttctagaagcagaaaaacgaaaatgccggcttgcttcctgctggagagtggatgtaatgaaaggaggaggagcaaaacgtcgttttgccttagcttctacacgagtgattgtatacgaggatttctctaacagctcggcatagtgacgggctttctcttcagagttaataagaaggacatcattttcggttttcccttcagggatttctttctcccacttttttccttgcacagcgtataaatgcgcccaaaacgtttttgtcgttttgggatcttgcattaaaacgcgtaaattccagtattcaacaggaacaaaagcatcaatagccttttctcgatctacgacaagcttcaaagctacagattgcacacgccctgcagatatccctgagcgttgttgtaactttcgacttaggataggagaaattttatatcccacaatgcggtcaagaagtctccgcgcttgttgtgcgttgactaaagccatatcgatggttcgagggtgttttaaggcctctgtaaccgcatttttggtaatggcattaaacgataccctctggatcagaggagagtcaggaagctgattcgcgatgtgccaggcaattgcctctccttctctatcagggtcaggggaaagatagactttttcacacttcgcggctagcttgcggatgtgattgatgacctcttgtttatcgggaagcacttggtattgtggttcgaaatcatgatccacatcaatgccaaattccttagcagggagatctacaatatgtcctatagatgaggcaaaaacaaattcactccctaataatttttgtagcgttttaatttttgcaggtgattctactataattaaggactttttcattaatctaattgcgtgaggaccctggatactttaccgagagaaaacgcgactcccttttattaatttaattttctaattcctaaaactttgttttcatgcaaatatatgttatttatttcaaggtttcgctgaaataataacacgcatgccaatagcaaagctcattaacagttacaataagtcactctagcagcttttcatgagtcggtgctcttagtttctcgatcatggaaaaataatcaactggatcgtccaacctatactgttgcgttttcatacgctaaataacaggaacgctggtctatatgaaggctagcatagagaattcttgatatgtccctatggttattgagtaagaagcaaattcttttcaagggaataatatgatagaaactatttaggtttcatcttgaacctgcaactgtcattcttttctgattagtaaaaagttttaaaataacacaacattaaaagagacgagatttcttattgccaagatgctaaaaccttttcaatttttcttgttaacgattgtaatttcttttaacaatgagaaaaaaggtttgaaaaagagccgagcatagatagaaacctaggacacgaaacgtggaaaaacttgagtttgtcaccagcctttcttctcctgatgatgatttgattactttcaataaacagggattgattgcaggcccagaagaagaaaaggtagcgtttcttgtacgtagcaatgctatgctagatgcaggacccgaaacccccgcgtcgtttcctgaatctttaagggaacaattcgatattttccctgagtatgttgaagtgctctactctaatgaaggattagatgtctgggaagcaggatgtacgtggattctaaataatgaagtgaccatccaactgcgtaaacatcaccggaaagcttcgcgatggctaggaatgtattccagagatgaggtactcgctcacgaagccgtgcatgctgtgagaatgaaatttcatgagcctgtctttgaagaggtgttagcttatcaaacttctcgttggggttggagaaggtttttcggtcctctatttcgctctccaggagagagctacttgctattattcttcaccattttaggtttaggaatctccttatggtatcctgccggtatactgattatgctggttttacctatgtattttttgatgcgattgtgcatggcgcagagctatttgtatcgggccatgaaaaagattcgtaaaatgctcggagtacctcccttatgggtgctgctaaggctgacggataaggaaataaaaatgtttgctaaagagcctattcctgttttggaacactatgctagaaaacgaaagcttgaaaatgtccgttggaagcaaatttatcaatcctactttgtttaactttaactagaactgcctatctctaaaatgactgtttgatgatcttatgtaaaacagcttttttcttttattagcaggcaggatctttagttgtgcacggtattttgctactgtacgtcgggcacaaggaatcccttttgcagtgattctgtcactgatcacactatcagatagaggagtttgttccgttgcgatccattggcggatccattgtagaacattctctttagaatgcgaggaatcttgatggattcctcgggggaagaggtgctttagagggaaaatccctataggagctgcaaccgctttgttttcaatggcacggaagattgttgactcatgaaaagagagatcttcagccaaatctttaatgcctaaaggatagggggctggaatttttcctaataaaaagtcttcttgtttggggagaagtgtctccatcacttgaaggagcgtttgttctcgttttctgagatttttgattagccactttgctgataaaatttgttgagagaggtttttctgctcttctttaggaaggtgttcatagaagtgaaacgtttctttattcagctttatagatggcaagcctcgagtactcacttcaattttccaagatcctgaggaataaaaaagataaatatcgggaagaggagttgataccatgggcttcacagtgcaagctgctgcaggacaccaaggtatagatcctaatgctttttttaaaatatttcgaagttcggataaagagagactgaactttttcataataggcgcaaactcacagttagtcatcaagggatagcaatcacggacgatgctataggcttgttggtgggaggagttgcggaggagcttcatccaatagctttgtagcgaaggagaggcaatgccttcaggacttaggttttgtatagtgtcccaaactttatgaattttttctaagggaagctcaagttcttgagcaaaatcctcaggatttcttagaaagagtccttcatccgagagattcccggcaatttgatgggcaatgaatcgttcttctgcagtagaaaaagcctcctcgatttgaggaaggagacgagtatataaagactcttgaggtccaggagtctgattcaaataggaaaacgtagagtttgtaggtcgataacaaggagaccattcttcctcttctagtgaagagagatcaaaaaaaggattatcaatgatctcttgaactacatacgatgataactcagtaagtggcgattgcagcatctgcaggccttgttgcatccttagtgagggtagatactttagagacaacttctgcttttgctgaaacatgtctaacgcacttgaatcatataatcttttggaatttcctttaaaaatctactgggcttcatcatccgtacggttccccagaggctgcgaacttgtgcggcagtaagatagaggagatcttgagctcgagtaattcctacgtagcataaccgtcgttcttcttcaatattttcataagtgccgcccagagagttcgcatgtggaagcaattgttcttctagacctacaagaaatgatacacggaactccaacccttttccattatgaagggtcatcaaattcacgcgatccgcagttaaatttagatcatcatcagagccttttaaggcaagatcatcaaggaaaagttccaaatgtgtctttggattttgttgttcggattccaaagctttatgatagagttcctctaaattgcttttccgatctttgaaggtatccgcatcttcttttaagatctcaaggtaacccgtgatcctaactacagactctataaaatctctaagggaaagagtattgtaggcatgttcaatttgagggaaaagtgcaagatactcttgaaggccttcttgttgttttttagataatttgacgtctttagtatccaaggcttgttggcatgctttgaggatagggagaccttgagcaattgcatattgcgtgagtgcaaatatcgttgttgaaccgatccctcgtttgggtagatttacagttctatcaaaagcaacgatgtcgcttttggaaataaagatacggagaaaggctaggatatcttggatttccttacgcttgtagaaggagagacccccgataatttcatagggaatgcgcctgcgaagtagagcgtcttcaaatgtccgagattgggagttcgttctatagaaaatacagatgtcacgtagttttatattcccgactctatgtaattgaagaatttctgcagcgacaaagtctgcttcttcgcgatctgtgcttcctaggaaaagacgaatcttttctccaggtcctttgacgctacgcaattctttttctaaccttgatgcgttatttttaatcagagcattagcggcatttagaatattgccataactgcggtagttttcttcgaggcataagactttagcattagggtaatcgttttcaaaatttaagatattgtgaatatttgctcctcgccaggagtagatagactgatcaggatccccaacagcaaagacattgcgatgttgctttgagaggagctgcattaaagtatattgtgcatggttggtatcttgatactcatcgatgagcaatgctttccataattggttatataattcctgtgcttcgggactttctctaagaagtcttacggttaaaaagagaagatcatcgaaatccagagcattcgcttcgataagtttcttttggtattcttggtatatcgagactacaggatcgatatagtcattgggatccaagtcttcgggaaagagtaaacggttctttgcttgtgagacgtgagcttgtattttgctcgcaagattaggtttgaggttgtgttgttgcaaggcatgcttgatgagcttttccgcgtcactttgatcataaatagtaaaattattttcacgatttagcagatttatagaacgtcggagaataaaaactcctaaactatgaaatgtacacaccatcggaacatcaaattcattagtggaagcacactgattgacaatacgttctttaagttctcgcgctgctttattcgtaaaagttacagccagaatttctcgaggcgcgatgccttggttaattaggtgtaagattctataggtaaccacacgagttttacctgctcctgctcctgctagaacgagtacaggattgagaggagctgttacagctttgcgttgtgcttcgttaagttctgagatacatgtcataataagtcctaatttttagctttacacctcgagactgacaatctctgtcgagctaaaataaaaagcgagtatactttcatcacaattatagaaaggtgatttatgcagaatgctactatagatcagctccctgtgtcttggcaagaacagcttcctttatgttggcgtgagcaacttaaggaagagtggtccaaaccctacatgcagcaacttcttatttttttaaaacaggagtataaagagcatactgtttaccctgaggagaattgcgtattttctgctttgagaagcacgccctttgatcaggtgcgtgttgttatcttgggtcaagatccttatccaggaaaggggcaagctcatggattgagctttagtgttcccgaaggtcagcgtttgcccccttctttaattaatattttccgagagttaaaaacagatttggggattgaaaatcataaggggtgtttgcagtcttgggcaaaccaagggatcttattattgaacacagtattgacggtgcgtgcgggagaacccttctctcatgctggtaaaggttgggagctgtttacagatgccattgtgacgaaactgattcaagagagaacccatatcatctttgttttatggggagctgctgcaagaaaaaaatgcgagcttttatttaattcaaaacatcaacatgcggttctatcctctcctcacccctctccgttagctgctcaccgtggtttttttggttgttcacacttttcaaaaattaactatctccttaataagctgaataaaccaatgattaattggaagctcccatgaatgaaggtatccactctgtctgttttcaaaaaacacctcggcttactgcgaagtccgtagtgagtatggagatgctcttaactactcaacagcttccttccgcagaagggatgccctcggttgctaatttggaagcggattttttacgagcagaagctctgttagcagaaatgcgagaaattcgtggttgcttggagcaatctttgcgaacactagtccctagtgagtaggtgtttttcaaataagctttgcaggtgaggggcgagtttttgcaatgcctttgctctgtgagaaacttgatttttcacatcttcactaagctcggcaaatgtttgtttgtaatcatattttacaaagatagggtcgtagccgaaccctgaagaacctttttcttgatggctgatgtagccctcgcatatcccatacgttttaaaaatctcctgattaggggagactaaaactacacaacactcgaagtacgcagaacggtctacgaggctttccaaagacgacataagatcaagcagcttttttcgatgatctttatcatacgcacctacaccagcaaagttcgcagataaaggacccggaagaccatttaaagcggggacgcgtaacatcgtatcatccgcaatgacccagcaacccaaatgattggcagcgtgaatccctttagtaagggcgttcgccgttatagaatctccctgttcttggggaagtttatagtcaggaaaatcagaaagagaaaaaatatcgaaatcacctaaacgctttaaaaaagtcttggtttctcgtattttataaccatgagaactagcaatcacaattttcatgaatctttcttaatcttttgaaattataaagttttaacaagatagagtcagcaagcgtaatgcgcaattattagccgatgaaaatctttgtagttaaagtacaacatacattgtatctacgcaatcgctagtaaggtagacattctagtttatttttgttctgaagaacttttatgattgcctgttgatgttttttcaatttttgagtttcacaatgaagaaaattttttactcttttgtattgttaagttgtattttcccttacgtagggtgtgctcaagtttttgtaggcttagatcgtattttttctgaaggggagtatacacgttgcattcaaggcaagaaaatcgctctaatttctcatagcgcagctatcaatagtcgtgggcaggatgccctctctgtattctattctcgtaagcatgattgtaccgtggaaatcctctgtacgttggaacacggctattatggagccacacctacagaaacggtggggaatcagccatccagatatccaaatttacgttctgtatccttgtatggagtgaaagaggttcccaaagaggttgccgaacattgtgatgtatttgtttatgatgttcaggatatcggagtgcgttcttatagctttgttaccgtgctgatgcaaatagtaaaggcttctgaacggtacggaaaacagctcattgttttagatcggccgaatcctatgggaggaaggattgttgatggacctcttcctaatcccacaacttcaggttccctagcgattccttattgttatggcatgacacctggggaattagcgttgttttttaaaaagacatacgctcctaacgctaatgttgtcgtgatccctatgaaagggtggaatcgctcgatgacctttgatgaaacaggattgatttggatgcccacaagtcctcaaatgccagatccacaatcaccgtttttctatgctgccacagggattttaggtgccttgtctgtagcaagtatcggtgtaggttataccttacctttcaaagtgctcggagctccttggatggacggggaaaaagttgccgacgagctgaatcgcatgaagcttcccggtgttctgtttcttccttttttctatgagccttttttcggaaaatacaaaatggagatgtgctccggggttcttcttgttcttcaagatcctaagattttctatccagtagaaacacaatgtacaatttggggtgtattaaaagcattatatcctaaacaggttgagcaaacgttaaaatccatagagcgcattcctgcacgtcgatcttccatatgcaatttatttgggggggatgaatttctcagcatatcgcacaaagagcgctatattgtatggccattgcgtaggttatgtaaagagtctcgagagagctttcatcaactgcgtagttcatgtttactctcagagtatgcagaatcctaacaagaacacttaagatcctctacggtttgacaggaatatttcttgtttctaagatgaccttttcatggcagaagcctttcctgcattaagaatagacatcagaggatcgagtggtttgggtatttaaaagtcaatttgagggactttcagcattaaaacgaggagtgcatgctcttactaaagctgtaaccccagcatttggacctcgagggtataacgtagtcatcaaaaaaggaaaagctcctattgtcttaacgaaaaacggaattcggattgctaaagaaatcatacttcaagacgcattcgaatctcttggagtaaagcttgcaaaggaagccttgctaaaagttgtagaacaaactggagatggctcaacaacagcccttgttgttatcgatgctctttttactcagggtctaaaaggcattgctgcaggtctagatcctcaggagatcaaagcaggcattctcttgtcagtggagatggtctaccagcaattacaaaggcaagctatagagttacagtctccaaaagacgttttgcatgtcgctatggttgcggcaaaccatgatgttactttaggtaccgtggtagcaactgtcatatcccaagccgatcttaaaggcgtcttctctagcaaagactctggaatttccaaaacacgtggtttaggaaaaagagtaaaaagtggatacctttctccctattttgttacgcgtccagagacaatggatgttgtgtgggaagaagctttagtgctcatcctatcccatagcctagtgtctttaagtgaagaactgattcggtatttagaactcatctctgaacagaacacccaccccttagtgatcatagcagaagattttgatcagaatgttttaagaactctgattttgaataagcttagaaacggtcttcctgtttgtgctgtgaaggctccaggatctagagaactgcgacaagtcgttttggaagatcttgctattttaacgggagctacccttataggacaagaatcagaaaactgtgaaataccagtttccttagatgttttggggcgtgtgaaacaggtcatgattactaaagaaacgtttaccttccttgagggagggggagatgctgagatcatacaagctaggaaacaggagctctgtttagcgatagctaggagtacctcagagagtgagtgtcaggaattagaagaacggttagcgatctttataggaagtatcccgcaagtgcaaattactgccgatacggatacagaacaaagggaacgacagttccagttagaatctgccttacgtgctacaaaagctgccatgaaaggtgggatagttcctggtgggggagtggctttcttacgagcagcacacgctatcgaggtgcctgcaaacctatcttcgggtatgacttttggttttgagactctcctacaagcggtacgaactcccttgaaggttttagctcagaactgtggtagatcttcagaagaagtcattcataccattctctctcacgagaaccctagatttggctataatggcatgacagatacattcgaggatcttgtagatgcagggatctgcgatcccctcattgtaacaacctcttcattaaaatgcgcagtttcggtatcatgcctcttgctaacgagttctttttttatcagctcaaggacgaaaacataatcagttgagttcttaataaggctgcctaaaacatgcgttgttgattgaggactctcttctaaaacatccttgatttgggatggtataacggaaatttctaagaaataaaaatttttagtaagattagttcattaaaaatttccacagcattttcttatagacagagaaaatgttgatcatttgatctttctgggatacactatgttgagcgaaaataggcaccagtagctcagtcggatagagtacctggctacgaaccaggtggtcagaggttcgagtcctctctggtgcggaacaataaaagagttgaagaagaggtttttatgacactctccctagttggaaaggaagcccctgattttgttgcgcaagctgttgttaatggcgaaacgtgtaccgtatctttaaaagattatttaggaaagtatgttgtgcttttcttctatcctaaagattttacttacgtgtgtcctacggaattgcacgcatttcaagatgctttaggagaattccacacccgaggagctgaagtcataggctgttccgtggatgacattgccacccatcaacagtggttagctactaagaaaaagcaaggtggtatcgaaggtattacctatcctcttctctcagacgaagataaagtcatttcaagaagttatcatgtgttaaaacccgaagaagaattatctttcagaggagttttcctgattgataaaggtggaatcatccgtcatcttgtagtgaatgatcttcctctaggccgttctatagaagaagaacttagaaccctagatgctttaatcttctttgaaactaatggcttagtctgtcctgcaaattggcatgaaggagagcgagcgatggctccaaatgaagaaggactgcaaaattatttcgggactatagactagaaaggctgattgaaagtcagcaagtcataaagatcgtgatcaaagaacaataaaaggctattgtgtttttggcataaagaccgagaagcttcaatgatgtgttgatttccaacaccaggaagtccgatagcaatgatgttttttaacgtcgtttgtgtatttaagaaatgcaaaccaaaaaagtaactatctacacagtagccttcttctcgaactctgaagtacactacattataatcacttaataatgttttaatagctaaagtgatgcctggactgctgacatctccaagataattatgtagatctacaagactacgacagaagtacgcagtatcgtaacttcctttttctgcttctccaaataaagcaactgtaaatttcatttgaaatatgagatcgaatctttatttctgatcgtacaggactgtttgtttattatctacagagagaaacttagttttgaaaagatttgcgaatctaagatggttattattgcttatttctttgtaaacaaagtcgttgcccagcatagatagcatcggaatctaatttattaattttctttaattcagttactgaaagtttatattttttagcaattttactaagactatcaccttcacgtactatataaatattctcaggaacaggatccgagaagtcagcataggctccaggagaagagctgtctactaaagcaagtaaagaacgtcgtactagacgcaaatcctgagctaaagctcggtgatctttttgaatttcttgtagtttactttgtaagttcgtctgtaagtctttaacagaagttgttagtacagctaatgttttcgcaagcgccttttgatcggactctagctcgcggattttttgagccagggtttctggttttgctgctgtccatttttggcatttagagtcttgttcatccaagcgctctgacaacatgacaatctccacttcgtgagaggctaattttgccgagatatcttcgatttctgcaaggactccttgtagagaaggagaccttccagcagcatgcaaacgactgcaatctattcctgaaaataacagacttagaagaataaaaaagcttagcttagcgtgcatgaatcttaaactctgtacggcgattttgttgccatgctagttcgttgtgtcccgaatttaaaggatgttcttttccgtaggaaatagtagatagacgatctgcagagattccctgctttcggagatgctctttaatcgcattggctcgtcgtgctcctaaagcaaggttataggatgcagctccacgctcgtcagtatgcccttcaatgtacagtgtagctttcgggtttttcttcatgtagtgaaccaagttcgtgagaatcgcaaggttctcttcacctttaattgtatagctgtctgtagcaaaggtgatattacgaaatgctgcaacttggcttgacttgtattgtttttcttctttggaatcatactcaccgaaggtaaaattagggttaaagtcctcttcggtatagagaggaacaaagccaaaagaagaaggcttttttcgtcttgtatgatggcatgtattacaggaatcctcccagccataattaggggaaaggctacatgctggcaatgcaagtaaagccaataaagtacaaagtttccatagggaatgtatattcatagtgttctctttatcggttgctgagggaaagcaccccaggaggggaaccgtttttctcctactcctatagcaattttgttagtttttttggtgactagactgattaaatataactctgattcttcagcattccccgcactaaagacaagatgacggctgtctatagcccaagaaggactctctttatttgtgggagacgtagtgagttggtaatcctctccagaggagagatcgtaaatacaaatttgtcgcacccctttaattacagagcagaaggctatttttttaccatctggagaccatgcagggcaactgctatttctgtatttttttgtcagcaagcgaggtgcttggggttcaggatcgagggacataatataaagacgcggacggccgtctttgttcgatataaagacaagctgggatccttcagggttgaaggagggattcccttgagtcccgaaattctcattaaggaggcgacgtgggcgacccataggtcctgaagttagtgagaacggttgaataaataaatcaggatttccatacgtatcagcaacgaaagctaaaagcttttttcttggagaaaacgtaggcatgagttggttgccttttaacggaaggacttttttaccttcagtgttctctagggaaccaagaaaaattttaggcacaccatacttatacgaaacatagagatagggaaaatttgatcccacacccacccattttggagttatagagagcgaacattctgtggttaaaggggcgaggtttttcccatcgtaatctgtagtccataattctccttgcttgagcttttgatcttttcctaaagaacttagagcaaaaacaattttcccagcactgattccaggaatccctgtgagggcgtaatgaactgtatcagcagcgtgatggattttttgacgatctacagaaagattttgagaaatagtaaaagaacataaggtttgaggagtttttgaagactgtaaaagcactacagatagctgaggtacatgcaaccgtaaagatattgctaaaggagatgacgattctttagaagccgctgtgggttgtagacaatctcctagggcaatgtccttgcaaaatatctccgttagcgagctgaggtatttctgtatttttggatctttcgtatcggtctggcaagagacctcaatagggagcgtgatatgttcggaacggacaacaacttctaattcttcagcatagactagcgatgcgaagcaaaagaaaaaaacttggaagcatagttgccgtaacatgccgatatctcctcaccctagggatagagcgttaggattcattactgaccagtttaatatgaaaagatatatttttcgagactttgtatttttcgagaaatttttgaaatgggagtgcttgaatcctctgagtgagcagctgtttgtcagcagcactcacctcagagagaaaactgcattcttgaatctctccattcggagaaaggactaatttaatacgcacataccctttagaggggagagctatgtgagtgcgaaataactcacatagctcgtcttcttgagttgctttaagttctgagtgcatggtcaattgggctgtagatggccaggagatatttttgagagaagtttcacttttctcaattttatctacatgtagggaaagggcttgggcaacttcggagagtgtttgtagttgggtttttgataactgtgtattttttttagttgtagagggaggaggtttctcagttgcggtcgttttttttgctacagtaggggctggtgatggtttaggaggttctgtttttataacttttggaatgggtttttgtagagccttctggacgttctcttgaggagggctgcatttagcttgtttttgtggctgcgtagctacagaggggcgtatcgttttagctggatctacaactactgagggagtagggacaggaggtttcggttggatagtgacgagtttttcttgaaaggctttgggttgtaaacgttttttaggaagaggagaagcaaagacaaggagaagaatccccccatgaatacatgccgtgattgctatatagggaagatacttcatcataattcaattctgtagggctacgtgaagttcgtgaaaccccgcagcttctatagcattctttacgttttgatatgtccgaaaggaggtttctccatcttgtagtaataggggggtcttttcaggataggctttatggaggagggtaaggcgaacagtgagctcttgtagtgtgatcggatgctcgttcaaagttaacgaatggtccgcaaatactttaattaccgctatagaatcgttttcgctgctcagcacttcttgctcttgtgtgccaggagcaagagctatagaatccagttttattaagggaacagcaacgataaatgccattaaaatgacaaagacaatatcaatcaacggcgttaagttcaccaggggctcttcttctatttcttccgtgaagcggtatttcataagtttgtattgcggtatttgacttctatagaattcagtagtaaatatgctgtctgctctatctcagaaatcaattccgaagaatgtgctttaagatagttaaaagcgatcagtgagggtatagcaacaaagagtcctataatcgtcgttcccagggctgtggcgagtccttccataatggctgagtttccactgcttcccgagctaatgtgggtaaaagcgactaaaattccccatactgtacctaaaagtcctagaaaaggagctaagctgatcgttgtcgccggaataaagctgtttttatgtaaaagagctttatatttcggcatgatggctcccaggagcgtctccaaagattggatatcttcagaagaaaggatgggacctcgatctggagccgattgccgatttttatctaagagctccaaagttccccgttttatagtaaaatacaagtccgcaaaggggctgagctctggatggatatccagagacagaggtgcgtgacggtttttaattaagaaatctttaagagactttcctgcttttaaaaaatttttttgaatggcaagcttttgatgtagtactgtccaagtacacacagaaagaataagaagacaaaagaatatacttttaccaaaaaaatctgcttccgtgtaggcctgaatgatggggttatgagagaagtgtaccatggaataaaaatctttatttacagagagtgtctcaaagtaaagatgatcctaacaaattttcgttatagagccaagcgggttttgtaaagaagatttataaaatggaatataaaaattaatgtataattagtaacttgatttataaaatcacggtgttattttgaataaattcaaaacatatttacaaaccgcattgatagcacctttcttttctttcccagcgttatctggaagtttttcctctatccaggcggaagaaattacacaacaagtgaatcatccaggtgcagaactcctttctgagggtagctacatccctggactacagacattccgattggggatcaagattacagcttccaaagggagccatatctactggaagaatcccggagaaattggaagtcctctcaaaatttcttggcagttgccgaaaggtttcgtggttgaagaagagcattggcctacccccaaagtatttgaggaagagggcactacattttttggatatgaagattccgctcttattgtcgcagatgtccgtgctcctgaaggatacactcctggtcaggaggtcgaattacgagctcaggtcgaatggctagcttgtggagatagttgcttgcccgggaacgtcgatctaaaattgacactgccctacgaagagaaggagccttctctttatcctgatacacacgcagaatttactaaaacgctgcatgcgcaacctcgtgttttagaaaatgatcactctgttcaagtggcgcaaggaaaaggaaatgagatcattttaaatatctctaagaagatcaacgctacgaaagcatggtttgtttctgaaaaagccgataagctttttgcttatgcagagacctcttatagcgggggaacaggaactgcatggagattaaaagtaaaaaatctctccggagttcagaagaatgagaagcttcatgggatactgctgttagccgaccacacaggtcgtcccgtagaatcactcaccattcatagtgaagttcttggtcaaacaggatctgctgtagcaggactgtcacaatatatcacaattttgatcatggcctttctcggcggggtcttgttgaatattatgccttgtgtgcttcctttagtgaccctgaaggtctacggtttaataaaatctgctggagagcaccgctcttctgtaattgccaatggcttatggtttactttaggggttgtaggatgtttctggggattggcaggtgttgcctttatacttaaggttttaggtcacaatatcggctggggcttccaactccaagagcctatgtttgttgccacattgatcatagtattcttcttatttgctttaagttctctagggctttttgaaatggggaccatgtttgcaaacctaggagggaagttacaatcttcagagatgaagagctctaataataaagctgtaggggccttttttaatggtattttagctacgctagtcacgactccttgtacaggacccttcttaggttccgtattgggattagtcatgtctttatctttcctgcagcagctcttgatttttactgcgataggcctggggatggcttcaccttacctagtcttttctgtatttccaaaaatgttgtccgtacttcctaagcctgggggatggatgagcaccttcaaacagctaacaggatttatgttgttagtaacggtaacttggttggtatggatttttggttctgaaacaagtacaacttctgttgttgttctccttggaggactgtggcttgcaggattaggagcttggattttaggacgttggggaacccccgtctctcctaaaaaacaacgtgtttgtgcttctttattgttctttgcattcctaggtggagccatctctgtaagtggtttagcttctcattactttgctgaacctcagcagacagtcagtgtgaacgaagatagtttatggcagcctttttccttagagaagcttgcccaattgcgagcccaaggtcgtcctgtttttgtgaacttcacggctaagtggtgcttgacttgtcagatgaacaagcctgttttgtatggtgatgctgtgcaaaagatgttcgaaactcatggaattgtgactttagaggcagattggacccgtaaggatccagggattacagaggagcttgctcggttaggtcgcgcaagtgtcccttcgtatgtctactatcctggagataactctgcacctgtcgtacttccagaaaagattacacaaaatcttttagaagacgtcgtaagtcgatttgtaaggtagctgttaagtgtagaaccaacacaagcattcgtaggtggaatcatccacgaggtaccttaaaaattgttagggcagcatatgctgccctttttatttgtaacaagaataccaaagttcacctgcctttaaaagcagagccgcttcaatcttgtgtagaatcttgagtctggggagcttaaattttccttagtaggacagagtctcgggagttcgctgtgttttaaggattcttctttagtgaagatattttcaagagaatgtattctatagggaattcttgccctgaatgttctacgactttgcttaaactaggagacaacccgtggatttggctgatgctcatgttcatctttctgatgatgcttttgaagaagatattaacagcgtattacagcgcgctcaagattctggagtgtcactagttgttaatgtaaccacaacagaaaaggaattaaatcgctcgtttgcgtatgccgaacgttttcctaaaattcgattttgccatgttggagggactccccctcaagatgtagatcaggatatcgaagaagactacaggaattttcatgctgcagcacatagtaagaaactcgccgcaatcggagaggtcggtttagattattgctttgccacggaagagggaatagcaaggcagaaagaggttctccaacgctatttggctttatctttagaatgcgaactcccacttgtagtgcattgtcgaggtgcttttaacgattttttccgtatgctagaccaatactaccataacgatccacgttcacgtccagggatgctgcattgctttacaggaaccttggaagaagctcaggaactgatctctcggggatggtttatttctataagtgggatcgtgacttttaaaaatgctcaagatttgcgagatctggttgtagaacttcctcttgagcatcttttaatagagacggatgcgccttttctggctcctgtaccttatcggggaaagaaaaatgagcctgcacatgtgctccatacgatcaacgccgttgccaatgtaaaagggatgttcccacaagagcttgcagctcttgcttacaagaacgtcttacgctttctgcacggttaatttgatggagttcatagaactccataacctttctattttgtcatataagcttctgtttcttatgaaaaattactttccataattttattctagcctctatcttgagttgaacttaaagtttagtaaaaagtcttagaatgtcacgacatgaaatctgcccagaagtgtcacacaagaaaggcaagtattatagcacctttatcttccgttgtattcactccttagcgggtatagcgtttacttttttcctatgtgaacacctatttacgaacatgctagcttcttcttacttttcccaggggaagggtttcgttgctatggtcaatggttttcataagatcccagggctgaaaattattgaagtggcgggtttagtccttccttttctctgtcatgcgattatcggcatcgtatatctctttcaaggaaaaagtaattgttattctggtgacggaagtcgacctcatttgcgttatgctaaaaattatagctatacgtggcaaaggtggactgcctggattttactctttggaattgctttccacgttgtgcatttgcgttttatccgttatccagtccatgttgatatccatggaactacctattatgctgtagacattcaaccttctcgctatgacgtgattgttagagggactaaaggctttttaactttgaatcttcccaatacagaagcttcgagtatcgaggtgtctcgtcatgatttaggtggtgctgatgctgcgttattgtcggagaggaactcctatttattgactccaagtgcaggtaccgcatttctttatgtagttcgtgatgccttgggatcactattcatagctcttctctatactattttggtcattgctgcagcatttcatgggtttaatgggttgtggaccttttgttgtcgttggggtgtcgttgtttctctgaggatgcaaggggtattgaggatagtatgttacctcgctatgattgttgtgactttcatgggagtgagtgcggtttggaatttgtatagtgtggcatagcaaatggatgagaatcgaaaagtaatcgttgttggtgggggattggcaggattatccgcagctatgcagttagccaaccttgggattattgtagagctcgtatctctgactaaagtcaagcgctcccattctgtatgtgctcaagggggaatcaacgctgccttaaatctgaagcctgaggaagaggattctccctacgtgcatgcctatgatacgattaaaggtggggattttcttgcagatcagcctcctgtcttggaaatgtgtcttgcagcacccagaatcattaaaatgttagataactttggttgtccttttaaccgtggtccttctgggaacttagatgttcgtagatttggaggtacgttataccaccgcacagtattctgtggagcttctacagggcagcagcttatgtatactttagatgagcaagtgcgacggcgagaacatgcgggtagggtgataaaacgagaaaatcatgaatttgtacgtttagttaccgaccattccggacgtgcttgcggcattatattaatgaacttgtttaataaccgtctggagattttacgaggcgatgctgtcattatagctacgggaggccccggagtgatctttaagatgtctacaaactcgactttctgtacgggagccgcgaacggaagactctttttacaaggcatggcctatgcaaacccagagtttatacaaattcaccctacagcaattcctggaagggataagctacgattaatttcagagtctgtgcgtggtgagggcggtcgtgtgtgggtgcctggggattcttcaaagcgcatagtatttccagatggttcggaacgtccttgtggagagacaggagctccttggtatttcttagaagatatgtatcctgcgtatgggaatcttgtcagccgagatgtaggagcgcgtgctattttacgtgtatgtgaagctggattaggaattgatggacgcatggaagcgtacttagatgtcactcatcttcccgagaaaacacgtcataagttagaagtcgttttagatatttataagaaatttactggcgaggaccccaatacggttcctatgaggattttccctgccgtgcactattctatgggaggtgcttgggtagattggcctgctgccgatgatcctgatcgtgatagtcgcttccgtcagatgacgaatattcctggatgttttaattgtggagaatctgatttccaatatcatggagccaatcgcttaggtgctaattctttactttcctgtttgtttgcgggtttggtttctggagatgaagcttctcgttttatagaggcttttggggcatcacaggcaacgtctagtgattttgatcgtgctctacagcaggaaaaagaggagaacgcgcgtcttttatctgcatcaggaaaagagaatatttttgttttgcatgaggaaatcgcaaagattatggtgcgaaatgttacggtaaaacgaaataatcgtgatctccaagaaactatggataaattgaaagaatttcgtgagagattaaaaaatgtctctgtattggactcttcaccatttgcgaataaatccttccattttgtacggcagatgggacccatgttagaactcgcactggcgattactaagggagctcttctacgcaatgagtttcggggttcccattacaaaccagaatttcctgagagagatgacgagcattggctgaagactacagtcgctgtttatgctcctgaagaacctgagatttcctatcttcctgtggatactcgccatgtagccccgactctccgggattacacaaaatcttcaacaggaaaaatagaactcacgaatattcctgataatatccgtctacccatatagaaaaagagagatgatggagaatctagagacttttattttaaaaatttacagaggcgttccagggaagcaatactgggaaagctttgaacttcctttacatcctggggaaaatgttatcagcgctcttatggaaatcgaaaagcgaccggtaaatatcttaggggaaaaggtcaatcctgtagtttgggagcagggttgcttagaagaggtctgcggatcctgttctattcttgtgaatggagttcctcgtcaggcatgtactgctctgatccaagaatatatcgatgcaacgcaatcccgagagattgtccttgctcctcttactaagttcccgttaatccgagatttaattgtagatagatcgattatgtttgataatctcgaaaggattcagggttgggttgctgcggatattgaaggagagacgtttggtcctcaagtcactcaggaacagcaagagcttctctatgcattgtcgcagtgtatgacgtgtggctgctgtacagaagcatgtccccaaattgataataaaagcgatttcataggtcctgcagcaatttcccaagcgcgttattttaatacgtatcctggagataagcggtctaagaaaagatggcgggctcttatgggtaaaggagggattgagggttgtggtcaagcgcataactgtgtccgtgtctgccctaagaaacttccccttacggagagcatctcggccgtgggacgtgaaatttcaaagttctctttaagaagtttattttcagctctttttaaaaagaaaaaataatctagaaaaattctttagggaggcggctgcggtagcctggaggcggtggcatgccataatctataggatttgcatagagggtccagggtcttgacgttgcgaacagctcctggatattgtcaagaggctgtccttgcagccctgcatagttaaatttccaaagatcgatctctgtggttcctggatttaggatgaatccaaaataaatagaaggccagttactgtctgcaaagagcaaaggagcgggataggcaagattatgatgcctcattgccgtggtgaggcggaggtacgtatcttcttcggtgtagatcttttgataactttgcatgaggagacctttatagatatgcctcaggtctgctgaggagagtaaggtcattttagggatggtttcctctatcagggagcggaatttctcataggtaatacgagaggaaatcccgagatatgaagagacgttatctaagacttctggaagctgttgttctgaaacataagggacttcacggaccataaggtagagaagacggcgtatatagataagagctacggtcttatctttggtgaataaggagcttagaaaacgcgatcctttgtcatagagctccggaagagtcaaggagtggtcggagcagaaatcatgaaagtcatgaactacatgttgcaaagcatatttgttacaaaaattctctatgaaagcatagatacttagctgaggtaatatagtatcttgaaggaaatcttggtgttgtttcacccagacatcacgaagccaggtatagctgtaccaatcattatcccaagcttcccgaaataaaggagatcctgcgattatagagaaaacgtgggtgggtgatgagctaagtagagagtgggatccttcttctagataacttttaattcctgtagggagatctttaagggcgtctgcgtagaaagctgcaagctcatgaggattttcaggatgcttttctgtaagtgtcagaggttctgagctttcaaaataatccaaaagaagagtgtccactgttcctccagaaacataaacccagggagtttgtgacagctgatctaagtggtttaagatggagggaggcacaggaagctgataggcttctaaaattcttgtaaggagagcttcttggaaaacatccgtgtgtagcatggcagtgatgttgtggacgagccgagatgtttctttctctaaattgatcacggcatgtttccccagaagttctgactctgtggaggtgaagaattcagaaagaaaacgtataaattcattaatcgaatagatgggggaccatgtgttcggatgggtgcgtccatgcgtgaaaagaatacggaagccagcgggagcattagcatagagatgagcaaattcttgaatgaaggcatcgtaagaactacgaaagtataagggaatttgctttgtatagaaagaaagtaagaattcaggaagatgtagaaatttctttgccttttcttgagcactatcccactcataaagagctttattgagttcttgacggaagcgcatgtgatccatcgtcaaaatctgactgtcttgattatttagtgggttgcgcatccgcccttcaatatattctagttgggagcgtgcttcgtgataggtctgttcacattgttggactaaaattcggatgttttctacttcctcttcaacaaagtgtgtaactagagatacaagactgtgagggtcttcacttttccatcctaaggcaaggcggatatggtttgagatggtaggttggctagcatccgcaagagtcgctaaagtatactcccaggctttcagtaagggattttgagtgtcatggataaaagcagattttgcttcttcataggcatgtaagtagtggtatacccgttgtatttctgagagctctctggggtgttgcgtcgagaatgccacttgttctttgctgaacaacccttctttgaagaaaatagctcgtacagtactttcttggagctgatagtagtgcagaagtgtcgatttgataatgtcgttagcagttaaggtctcatggacattttgtagtttttgcatcaaatattgatgcgagagcaactgttggatttgtgcttcagaatccccaagagtttcaataagattggcagcagaaaaggcttttttgagtcctggagatgaggagagcttaaccagaggatcaggataaagatctagaatccttaaaggcttgaatagctctccaatgcatcccgaaaggtttataggaaccgcaatttccctttggtttacgattctagagagtttgccactgctaatgagatcattgagatctttaaggaatcgttctggatattcttggtgaatgagaatggcaggagccgtagcaaaacaggaacctacatcttgccgaaggtaggtgaagagcgctgtgagtgctgcttgacgcacatgaatcgtagagagaattgtctgtggattcaatgctagtgtatggcgaattaggttttggattgtagagtatgaagggacaaagagagttttgatgctttcttttaatttaggattttcctttagagcttttagcattttaaggaggtgttcacgatcttgagcttcattatggcgatgaggccctaaaggataggtacattgtgagagatggtgaatggcttcgacaagctttactgtatcgatttccccattgtcagctaagatataatttgcgactttacgggcgatatttaggttcttagcagctagaggggattgtagagccgtagtacggtaggctttaaataaaactgtgtcttcagaacagaaaatttcctcaagaagattttgatcctggtttgcgatcagagaatcgaaaacaaaaatatccaaacgtgacataggatgtagaagatagttatgggatattcctttgctgtaacacgaatacatgtttctgtcactgatatcctccactactatttttctagagctccgaaggcaagtttatgaaaatgaaaggatggtcagagttccatctgcagaatgttcggtttcgttgtttaacatcatggttagagaatcaataagattctctgtatttagagggtttaaaggatcttttaagagctcttcaataggaagctgagaaaagtacttgaggatgtcttctcctccagtgaggcagatcaaccgatctccaggctgtagagcttggtgagtctctaaggggagacgtacgaaagattctcctcgttgtagaaacatggtaggagctccctcgcttaacgagaggagctctagagatcgatctttttctacatatttaatgaaagtcatagcaactacagcctcattgccttctgttgtttttgagaagctgtcggcagtatccttgctgattttttgtaacgaaacgtccgaggaagcataggcaagaaaaagactccgtgcggataaagcatagagataggaaggaagaccaatatcgccagcgagccctatgatccctaaaagggtatcgccaccatcttgaactgtccaaccattaaaatgaccggaaagttgccttctccggagatgttgggaactaaaggtaactttagggaacgtagggaaatccggacttagtaacgcactttgtagtgaagataaaatccctaattctttttgtaatttttcgcctgaatggtaatcgatatctgctttctcaatggaattcaataagagtaggagagtgcaattgaaaatatttcctagttcattgaattcataaccgtaaggctggggttcaaacctcacgttatggtttcctcgccaggcagcttccatacagaaggtcagttcttgaagaggcttgttaagtttggtgttgatcttagagaaaatccaccacatgaggaggaaagcaagtacatagaaaaaacaaatattgagaggaactttcaaggcggattggatgagatcagaaactggaactaaagatagagtgtaggtcccttggataggaattttattcagtaccaatcctaggtagcgtttcttgttgatactcactgtgattaggttctccccaccaagaattccagaagctttctcaatttctatggcagaggggcttcttgcttggaattgcggtaaattagggagatctagagaaaatacaaaagaagattcactgtcctgagcacagaagaggacctcgccatacttatttacaaggcagatatttcctttggtgatgtgtaaggattggaataaatctttctgtaaaaaagacatgggatagaaacttacaagcagtcctgaagtcgttgtagaatcccaagatgcgacatcttcaactagaataagataatgtaaaagtggtttacctggaatggtcaataaaaaggctttccctacagctgcggatagctttttcttcatttcaggatgctgttttagatagcgaatgaaagggtctccaggatttttcgtccttacagatccatcaaagggatctataaggcataaggaaaagtctgtattggagagtgccatcatctcattgtatgcctgtgcatagggctctgcagaaggagatgcataggattttaaggctaatgtgttggcaagtctatcgaggaaaagcttgtgtatcgtcagttttttttcgaattctatacttaagttcgtagcacgggtatggaggacctgtactaaatttgctttagcggcagaaaatgagaaaaaacctacgaccataagattgaggagtaggggaatgggaatcactaaaaagaaaaaaaatagaacacgcttggtaaaggtatgtttcatgattctaatacctttaatattaataaggtgatgtcgtcatgttgatgggagttcccgacaaaggtttttacacttaacatcaacctgtggacggcatcagcagcacttttccctgtcaatccttgaattgcagcttgtaggcgctcttctccaaacatgtcgttattgttattatgggcttctgtaataccatcagaatacaagacaaagagagaccctggcttaggatgaaatagctttgaagtgatgttcgcaacttcgggaaggaagcctaaagccattccaggatggaatagccaagaagtctcgccatcaggatctaggtagcaggcaggaggatgtccacaagaataatattccatggtgttggaagtttgatgataacagtacacacatagagtgacaaacatccctgagttttttgtattgttataaaataagcgtgaggtttcttggattgcctgttgaagagacgaagagcgagaaaggaatgttctgagcatattttttagaaatagcgaatacccacaagcattaacacctttccctgaggcgtcagcaacaatcaggaataggcgagccttcgaaccctctcctacaacaaaaacatcaaagaaatcaccacctacagtaatggcagggatataggcttttgcgagttctatatgaggatagctggggagagtattaggaagaagtcgctgctgagcctgctctcctaaatgtagagcgttctgtgcattttctttcatctcaaagttcgtcttagcgaggtgttgctgtttgtggagattctccaccatagcattaaaaatatggccaagtctgttgatctcaaaccctaaggagtcgtcagtatagaggcagtttttgtttttcctagattctatcatcgcagtggcaagttttctgataggtaacgacaatcgtcttgctacaataaaggctatgaggctccctaagagaatgcaaaagaaataggcagtgtacatgcgagctctgcgccataaaggcgcaaagctctcttcttttttagcataggaaaggactgcaatatctatactgggaacattttcaatacagccccaaatctcagtatctttgattttaaaagaatagaaattttctccaatatccagaggggagagagttaaaggacctaattctgagtctatagggcaaggatcatcattgagaaaaacttggcagaatttttctttcgtcatgtcagggtagacagtatggagatggagagcaggatcagaagcttttaagataacgccgtatttggaaaggatcgcagtttttacagtgagataggattgcttgtttatcaggagatctttgagtaagctctcagcactgaacgtggtgtataagatcccttggagttcttgagtttttgcatcaaaaacattagcttgcattacagaaaagacttcctgatttttaggagattgttttagggctgctaaaaatggagtgttcttagggatgtctattttgtgattatagttttcccctaagtgttcaggaatgctagaagcaacaacaattttatctccatttgggaataccttgattaaagagatttcattatagatcccttggaatactttctgcatttcattgctaaggagaacgttcggagtctctggaataccagcatctaaatctaagacatcagaaaatagagatagaacatcgacattcaaagggacaatctgagtgagagtattggctttgaaagcagcgttttctttcagtgcagtagaaatagcagagactatggtgcggtattgatctaggtttaaccatacgatgttgatccctagaggtgcaatgatagcaacggcgcaagccaaccacaaacggaaccctattgttttagtaaaagggatcatgggtattacggcgctctattcttaaggcttgtcatccttgagaaggaacgtctttcctctagtgttttgtttcttacgcagtataaaaaaatttccttaaggagacacctactatttcttttattcttgctatatcttagtaaatcaattgcttgcaacgaagatcttattttttcatctcgatcttctaatgaatgaaaatattattctctaacttcttttaaatcacatggatgtttgagaatatagacaataaaaattgttaaagcttttgttttttactcacaatacttatgtagaaatcttctaaacacagaagctttctactaaaaaagagcggagggaatcaagtgagtctatatcaaaaatggtggaacagtcagttaaagaagagcctctgctattcgactgttgctgctctaatatttatgattccttctcaagaatcctttgcagatagtcttatagatttaaatttaggtttagatccttcggtcgaatgtctgtcaggagatggtgcattttctgttgggtattttactaaggcgggatcgactcccgtagaatatcagccgtttaaatacgacgtatctaagaagacattcacaatcctttccgtagaaacggcaaatcagagcggctatgcttacggaatctcctacgatggcacgatcactgtaggaacgtgtagcctaggtgcaggaaaatataacggcgcaaaatggagtgcggatggcactttaacacccttaactggaatcacgggggggacgtcacatacggaagcgcgtgcgatttctaaggatactcaggtgatcgagggtttctcatatgatgcttcagggcaacccaaggctgtgcagtgggcaagcggagcgactacagtaacacaattagcagatatttcaggaggctctagaagctcttatgcgtatgctatatctgatgatggcacgattattgttgggtctatggagagcacgataacaaggaaaactacagctgtaaaatgggtaaataatgttcctacgtatctgggaaccttaggaggagatgcttctacaggtctttatatttctggagacggcaccgtgattgtaggtgcggcaaatacagcaactgtaaccaatgggaatcaggaatcccacgcctatatgtataaagataaccaaatgaaagattgaggaactttaggaggggcgaattcttcagcaactggagtttcttcagacggttctgtgattgttggtcaggcgcagacagccgataaatccgtgcatgcttttcaatactataatggtgagatgaaagatttggggactcttgggggtacctcttctacagcaaaaacagtgtccccagatggtaaagtgatcatgggtagatcacaaattgctgatggcagttggcacgcatttatgtgtcatacggatttctcctctaataatgtactctttgatctcgataatacgtataaaactctaagagaaaatggccgtcagctaaattccatattcaacctacaaaatatgatgttacagagagcctcagatcatgagttcacagagtttggaaggagtaacatcgctcttggtgccgggctttatgtgaatgccttgcagaatctccctagcaatttagcagcacaatattttggaatcgcatacaaaatacgtcctaaatatcgtttgggggtgtttttggaccataatttcagctcccacgttcctaataattttaacgtaagccacaatagactctggatgggagcctttattggatggcaggattctgatgctctaggatctagtgtcaaggtgtctttcggatatggaaaacaaaaagccacgattacaagagagcaattagagaatacagaagccgggagtggggagagccattttgaaggggtcgctgctcagatagaagggcggtatggtaagagcctcggaggacatgtcagggtccagcctttcctaggactgcagtttgtccacattacaaggaaagaatataccgaaaatgcagtgcaatttcctgtacactatgatcctatagactattctacaggtgtagtgtatttaggaattggatctcatattgcacttgtagattctttacatgtaggcacacgcatgggaatggagcaaaactttgcagcccatacggacaggttctcaggatctatagcgtctattggaaactttgtgtttgaaaagcttgatgtgactcacacaagggcatttgcggaaatgcgtgtcaactatgagcttccctatctacagtctctgaatcttattctacgagttaatcaacagcctctacaaggggttatgggattttccagtgatcttaggtatgccttaggattctaaagaagaaaatttaattttcttgcgaacatttctatccatagttgatagagataaacagataaaatatagctcagaatataatctgagctatattcttcttacttgcagccatgtctgaatatgagtatagtcagaaattctgcattgccacttccgtgtttaagcagatccgaaacctttaaaaaagttaggtcgcatatgaaatttatgaaagtccttactccatggatttatcgaaaagatctttgggtaacagcattcttactgacagcaattccaggatcttttgcacatactcttgttgatatagcaggagaacctcggcatgctgctcaagcaacaggagtttctggagatggtaaaattgttataggaatgaaagttccggatgatccttttgctataactgtaggatttcaatatattgatgggcatttgcaacccttagaggcagtacgtcctcaatgctctgtataccctaatggtataaccccggacggaacggttattgtgggtacaaactatgccatcgggatgggtagtgttgctgtgaaatgggtaaatggcaaggtttctgaacttcccatgctccctgacaccctcgattctgtagcatcggcagtttctgcagatggaagagtgattggagggaatagaaatataaatcttggcgcttctgttgctgtgaaatgggaggacgacgtgattacacaacttccttctcttcctgatgctatgaatgcttgtgttaacggaatttcttcagatggttctataattgtaggaaccatggtagacgtgtcatggagaaataccgcagtacaatggatcggggatcagctctctgttattgggactttaggaggaactacttctgttgctagtgcaatctcaacagatggcactgtgattgtaggaggttctgaaaatgcagattctcagactcatgcctatgcttataaaaacggtgttatgagcgatatagggaccctcggaggtttttattctttagcacatgcagtatcttcagatggttctgtgattgtaggagtatccacgaactctgagcatagatatcatgcattccaatatgctgatggacagatggtagatttaggaactttaggagggcctgaatcttatgctcaaggtgtgtctggagatggaaaggtaattgtgggtagagcacaagtaccatctggagattggcatgcgttcctatgtcctttccaagctccgagccctgctcctgtccatgggggaagcactgtcgtaactagccagaatccacgtggaatggtagatatcaatgctacgtactcctctttgaaaaatagccaacaacaactacaaagattgcttatccagcatagtgcaaaagttgaaagtgtatcctcaggagcaccatcttttacaagtgtgaaaggtgcgatctcaaaacagagccctgcagtgcaaaatgatgtacagaaagggacgtttttaagttaccgttcccaagttcatggaaacgtgcagaatcagcaattgctcacaggagcttttatggactggaaactcgcttcagctcctaaatgcggctttaaagtagctctccactatggctctcaagatgctctcgtagaacgtgcagctcttccttacacagaacaaggcttaggaagcagtgtcttgtcaggttttggaggacaagttcaaggacgctatgactttaatttaggagaaactgttgttctgcaaccctttatgggcattcaagttctccacctaagtagagaagggtattctgagaagaatgttcgatttcctgtaagctatgattctgtagcctactcagcagctactagctttatgggtgcgcatgtatttgcctccctaagccctaaaatgagtacagcagcaactttaggtgtggagagagatctgaattcacatatagatgaatttaagggatccgtctctgctatgggaaactttgtcttggaaaattctacagtgagtgttttaagaccttttgcttctcttgctatgtactatgacgtaagacaacagcaactcgtgacgttgtcagtagttatgaatcaacaacccttaacaggcacactaagcttagtaagccaaagtagctataatcttagcttctaagctattgttcaataaataatcagaacatgtgcagtccatagttggaaatgctgattaagtacccaactatggactcttctttttagttttaaaaatacacagatacaacgtgtagtgcctttaaaggttcagagactaataaaaatatttttaatttcttctggcaattcttccgccatatccttataactataagccgtttaactaagtgttgattttaacttggatcaacgtacttacaaagttaggtttaaatatgagtaagaagataaaggttctaggtcatttgacgctctgcactctgtttagaggagtgctgtgtgcagcggccctttccaacataggatatgcgagtacttctcaggaatcaccatatcagaagtctatagaagactggaaagggtatacctttacagatcttgagttactgagtaaggaagggtggtctgaagctcatgcagtttctggaaatggcagtagaattgtaggagcttcgggagctggccaaggtagtgtgactgctgtcatatgggaaagtcacctgataaaacatctcggcactttaggtggcgaggcttcatctgcagagggaatttcaaaggatggagaggtggtcgttgggtggtcagatactagagagggatatactcatgcctttgtcttcgacggtagagatatgaaagatctcggtactctaggagctacctattctgtagcaaggggtgtttctggagatggtagtatcatcgtaggagtctctgcaactgctcgtggagaggattacggatggcaagttggtgtcaagtgggaaaaagggaaaatcaaacaattgaagttgttgcctcaaggtctctggtctgaggcgaatgcaatctctgaggatggtacggtgattgtcgggagaggggaaatctctcgcaatcacatcgttgctgtaaaatggaataaaaatgctgtgtatagtttggggactctcggaggtagtgtcgcttcagcagaggctatatcggcaaatgggaaagtaattgtaggatggtccacgactaataatggtgagactcatgcctttatgcacaaagatgagacaatgcacgatctcggcactctaggaggaggtttttctgtcgcaactggagtttctgctgatgggagagccatcgtaggattttcagcagtgaagaccggagaaattcatgctttttactatgcagaaggagaaatggaggatttaacaactttgggaggggaagaagctcgagtgttcgacatatctagcgaaggaaacgatatcattggctctataaaaactgacgctggagctgaacgcgcctatctgttccatatacataaataaaagcatcgtagagaaaagataaacgaagtaaatcgtaagcttggaattcatgaagtgattcataattccaattttcatacttgttgtcttttctctatgtagataaagttaagtggtttttgaaattatttttgttgttagagtccctatgaaaaagacatgttgccaaaattacagatcgataggcgttgtgttctctgtggtacttttcgttcttacaacacagacgctgtttgcaggacattttattgatattggaacttctggattatattcttgggctcgaggtgtatctggagatggccgcgttgtcgtaggttatgaaggtggcaatgcatttaaatatgttgatggtgagaaatttctgttagaaggtttggtcccgagatccgaggccttggtatttaaagcttcttatgatggctctgtaattataggaatctcggatcaagatccgtcttgccgcgctgtgaagtgggtaaacggtgcacttgttgatcttggaatattttctgagggaatgcaatcttttgcagagggtgtttccagtgatggaaagacgattgtagggtgcctatatagtgatgatacagagacaaactttgctgtgaagtgggatgaaacaggaatggttgttctccctaacttaccagaagatcgacattcttgcgcttgggatgcctctgaagatggctctgtgattgtaggggacgccatgggtagcgaggaaattgccaaggcagtgtactggaaggacggtgaacaacatctgctttctaatatcccaggagctaaaagatcgtcagcacatgcagtttctaaagatggatcttttatcgtaggcgagttcatcagtgaagaaaatgaagttcatgcctttgtttatcacaacggtgttatcaaagatatcgggactttaggaggagattactctgtagcaactggagtttctagggatggtaaggtcatcgtgggtcattctacaagaacagatggtgaataccgtgcatttaaatatgtggatggaagaatgatagatttggggactttaggaggttcagcatcttttgcttttggtgtttctgacgatggcaaaacaatcgtaggaaaatttgaaacagagctaggagaatgtcatgcctttatctaccttgatgattagggttcttatggaagtcgtcctatactcagaaaattgctaacacatcaacgtagataaatgtagataactgacgattcttattctgattggactccaacaataatttctccatcaatagaaacagcgtttgcacaggcttctttccagctatactctcctaagtcgatcattcttccaccgacatatttaaaggcatgcaatttcccatttgctgttgtggacataccgacaataacttttccagttgcagagactcccttagctgcagaataagatcctccgagggtgccgaggtctgacatgacgccattcttatgacagaaagcatggacctctccataatatgtttcggatctccctacaatgaccttgccattattggatacagcttttgcaatggcagaatagcctcctaaagttcctagatgtgtaatagtgttcccttcccactttacagcataaagaattccagaggcgtcttgtacagaccctacaattatagatccattggcagatacagaattcgctacagatttgacagcccagcctactggtaacacctgagcctcgtgtcccgtccacttcacagcgaaagttcgcgaccaagcatccttagcactccctacaataacagagccatcagaagaaattccatacgctttagattgcactgcccatgtggaagggagcaaatacatttcattgtttttccatgtgactgcgaaactttgagaaagctcattctcgacaatccccgcgattatagacccatcagaggagattcctgttgcttttgatttttttacccatgagctggtagggagttctttggtcccccaataattccatcttactgcgtatgttcgagaccaagtgtcttttataaagccgacagttgtagcaccagttcctgaaacagcttttgcagaggcttttttatttgataatcttgagagagttgtctttccccaatgatcccattttactgcggatgaagaatggaagtcatcttctggtttgtctgtaattacatagcaataaccagatagagaatataatgaaaataggaccatccataagctactctgagatagcatagaacgtaaaatttgttttatagctgccatattttcctctcgttttcaaggtttgcaaatgaatttttttttaatccaagaaactataccaagatatcaaaagagctacaagcaagatcctaggagcggttttttaatgaaaatagaataagaaaggatttatagacgtgctgatgaagatgtcttgaaagagggaaataaagaacacattgcagatcagaaagataaggcccatagatctgcgatgtattcttgatttggagataagatagaaatagagaaaatccctctattcctcagaatcctcgtaagaaaatacattagaatctgtgaaaattgcttcggatccaagctcttcttcaatttccatgagtctattgtattttgcaacacgctcagaacgtgataaagagcctgttttgatttgaccggcgttgaaggcaacagcaagatctgcaatcgtagtgtccgtagtttctcctgagcgatgagaaataattgtagtatagccagccatttgcgcaagcttgatagcatacactgtttcagtaagcgtccctatctgatttggtttaatcaacacagagttcgctaatccattgctaataccctctaatattaattccggatttgtaacaaataggtcatcacccacaatctgtactttttctccaagaacttcagttaacaaggcccacccgtcatagtcttcttcagcaagaccatcttctatggagtctataggatagcgatcacataaattagaaaggattgcgatttgctcttcatagtgcctcccatcatacgtgcctgtttttacgttatagaatgaggatgctgcgcagtctaaggctagcgatatatcttttcctggagtaaagcctgctttttcaatagccagcaataggagctctagagcttcttcattagaagcaagattcggggcgaagcctccttcgtcacccactccagtagataagcctctttcatggagtaattttttcaaagtatgaaaaacgtcagcacccatgttgacagcttctttgatggaagaggctccaataggacggatcataaattcttggaactccaagccgttatcggcatgcatgcctccattgatcagattcatcataggacagggaagactgcaggcaaaacaccctcctaaataacgatacagaggtctgcgtagtgttgctgctgctgcatgtgctgtagctagagagactcctaaaatagcattggcccctagagtttctttgttcggagagccgtcagaatccatcatcagagaatcaattaaggattgctcataaacactacatcccttgacgaggggaaaaagaatttcttttacgttttttacagcttgcaaaacccctttgccttgataacgaggagaatctgtatcacgaaactctaaggcttcttttttccctgtggatgctcctgaaggaacccgagcttctccaacagaacctgtgctagtggttactttaacatgtaaagtgggatacccgcgagaatccaagatttccctagcctggatatcggcaatgacagcttcaaacataatttttatctcttttctttaagactttgctaagagctcaatagcatgtgaacctactgatcctgctctgcttcttgaactgtagatatgtattctaaaatacgtagctacggattcacatcaaactcataatgacaaaaatagataaatttggggaggaatattcttgaatatcgagatcagaaattctcttagaacaaatagagaagctgttctttgcaagcttgcattgcatcgcggtatttcgcagcttcgttgaatcgaaattctttagcagcacgttgcatgagagcttcgtatttcttaatttgctcttcaagatcttctttagatagggggcgttgagattccttgggagactccgagtctttagaggtttgtagaataggattggcaaaaatagcttttataatgggcttaggaacaatattgtgctctttattgtaatctaactgtatctgacgccggcgttcggtctctcgaagagtctcctctatagaacgggttttttgatcagcatagaaaatgactttaccattgatattcctagcagctcttccacaaaactgaatcagagatgacgtgcttcttaaaaagccctctttgtcagcatctaagatcgcaactaaagagacctcgggaagatcgagtccttcacgtaggagattgactccaatcaatacgtcaataacgcccgagcgtaggtctgtaaggatttgcgtgcgttctgcagtttctattccagaatgcaagtatgccgcagggatctctaattctgaaagaaaacccgccatatcttcggcaagtttctttgttatagaaatcactaggattttttcatgtttctgagacagccgcaaacgaatttcttcaagaagatcatccacttgtcctgtagcaggacggatttcaggcataggatcggggatccccgtcgggcggatgatttgttgtacaatatgacctgagctctcttggacttccgtatcacctggtgttgcagagacatagatgactttacgaaagtacttctgggcttcttcataggttagcgggcggttatcgaaggctgaggggagacggaatccatattctactaaagattgcttccgagattggtctccacgatacatagcacgtatttgaggtagtgtttgatgagactcatcgataataaggagaaagtcctcaggaaaataatctaagaggcacgtaggcggtgctcctgggggcgcccctgtaaaatgccgtgaatagttttctatgcccttgcagaatccgatttccttgatcatctcaatgtcatgagtcgtacgatggaaaatgcggtccttttctataggacggtcgtcaaaaaaggccatgcgctcttctaactcttcctgaatggttcggatcgcttgctcgcgaattgcctcaggaatgacgtaatgagatccaggatataaagtagccgaagggacactttccttgggaatcatagtgaggggatcgctgtattctatggaggtaagggtgtcatttagaaattctaatcttagggcaagttcactttcgtatgcagggaaaatatcgattacactcccacgctctcgaaatgcacttctctgtgggatgggagatgcttgatagtgcattttaacaagctgagctgtcaggatattcctagggtactctttccctacctctaagactaacgccatggatgtatagttttcaggagaaccaataccataaatgcaagatactgaggaaacgattaaagtgtctcggcgctctaaaatagaccgtgttgctgataaacgtaacttatcgatttcatcattgataaggaggcttttttctatataggtatcactacgggcaatataggcctcaggttgatagtaatcgtagtaagagatgaaatactcaacggcattattagggaaaaattcacgaaattcttgatacagctgagcagctagcgttttgttatgggctaaaaccagggtagggagatttacgttggcaacaacattcgcaatagtgaatgtcttcccagaacctgtagttccaagaagtacttgtgattttacctgattacgcacacccgcagacagccgagcaatcgcctctggctggtcgccgcaaggagcaaaaggagcatgaagttggaatgtcatagtaaaaattatttaagcaatgagcgccatttatggctaaacccaaatttgtcatgaacttcttccatagtgactttggctacttcacgcattttatgcgtgccatcctctaagacgttttgtaatgccagaggcttggatagaaattctgagcgtctttcttttatgggttttaaaaagtgaatcagctcttcagcaaggcgtgcttttacttcgatgtctttaatgcaaccttgacgatagcgtgctttaaactcttcaacctcatctttatggggattgaagatgtcatgataaataaagaggggatttccttcaactcgacctggtgtggttgctcgaatccggttgggatccgtgtacatcttacggactttctcagtaattgtagcgtcgctatcggaaagatagatcgcgttgttcgcggacttgctcattttcccttgcccgtcaattcctacaagagaggtaagctcgccttgtagtacctcgggctctggaaatacctgcccatacagacggttgaaatttctagcgatatcccgggtgagctccacatgcgcttcattgtctttccctacagggacaaactgtgctttcgctagaagaatatccgcactttgtaaaatagggtacccaataagaccataagaaagacttccctcctcgattgaggcatttcgggccatatctttgaggctgggaatgcccatcactctattgattgagatgagcatcgaaaataggagatgtaactcgtagatctcagggatcgcagattgtaggtaaattatagatttcgttggatcaatccctacacttagccaatcagcaagaacttcatagatgtggttatctacatctaaaacctcttccttgcggatttttgtagttagggtgtggagatcggcaataataaaaaagcaatcgtactcagggctattttgaagttctaatcggttttttatagaaccaacccaatgccctaaatggagtttccctgtgggacgatccccggtaagtacgcgcttttttttattcatgacgtccgctattgaagtgctttagttagctcatcaaagtgattttttaatgatgtaatttcttcttgaatttcctgaagatttttctctccaacaggattcttttgtgcttctaaaagtcttgctagtaaatgacgaatcaagtggcaggtattctgcacatcagtcatcaataagaactcttgaccatcgacacgagctaatcgatttaagaaaatacaacgctcttgttgggtaagcatatctgaagtgatgaaattaataaattccccgcgttcatggatgtctttagcgacacgaataggcatcataaattcggcaattaaactatgcgcagcttgcttttgctgaggagcaagttcttgtgttaacttgccattaattaacatctcgaaaaagaaatttgcaatctcttgctgaccattggcacagttgaaaacgacattttgaaattctcgaaaggttgtgtaaccaataggagtagcaaaaattctttttaaatttccttcaagaaggagaaaaacattgtcttcaagctctaatgtttttgtctttgctgccataaatcatacctttgtatcgggaaagaggttacttttaactttttctagtttttttatcaatttttccaaaatgatctgctcatcagaagagagactcgtacacttagttagtatttgagagcctttggtaagcatagcaagagcctgctttactggtgatgtttttctacaatctgtctcaactaaggggaactctttgcgaatgcgatctaaaagctcgctttttctttcccctcggtagtttcggataatctcttcttttttttcttggggcccttgacgagatgctaaagtatagacagcttgtctaggcatcttttccatctctatttttaaaggttcaggaagaagggtaaagagttcgtagtaaactaaaaaattatagggggtttgtctattcccataggttaagagaagccaagaagaaaaagcaccttcacgatagcttttcagtaaatcacggacttttgtgatgcgctccccatgtaaaaggacagattgatgatggatttgcttcacttcagcagaaagagtacagagctgggtaagatcaggttcttcaatctgttctcgaaagttgtagtgctgaagcagatgacggagttgctctttttctttagaggaaagcgtaggattggaaaggcgaacggcaagaggagagggatctccttccatgcgtttacgggcaagcgcttccattttagtgggagtattctttttgaagcgactttctaagagcgtttttagattccccatagagctaaatatctcttaataaaattagcaattctttagtgaggttgaaataatcttcagaggcacgtgcactgggagatgtagcaaagacaggtttgccatgaatcgcagcttctgaaacagtgatgtctctacgtattttcgtattcaataacttcccggggaaagttttgtgaatcagctcagcaaatgcggaattgtttttccctctgcaattccaaaaggataaggcaactcctaaaatcgttaggggatgtcgtgctgaaattccttggatgaaaccagccagacgttctagacctttgacactataaaattctggggtagcgcaaataagcgcataatcagcagcaattagggcagattctgtaagccaacaaagtgaaggaggagtatcaataatcacatagtcgtacttgtcttggacagaaccaagtacatatttcagtctttcatgagaatagcgatccgcagcaagatttcctgacacttcaatacgctctaaccaggtgtcagcaggaattaaatccagctgagtgtcttggatgggtcggatgacttcttgaatttctttttcgccttgtaacacaacagcaaggctgtcatagcaatcaggatctaagcctaatccagaggtgagatttgcttgagcgtcaaaatcaataagcaataccctggcttgatggtactgggcaagagccgcaccaagatgaagggttgttgatgtttttgctgttccacctttaaagctgtttacagcgatggtcttcattcttgatgcgtatcctcaaaaatccttagcaactacaataatgcagttaaacttaaagagttcttttcttcaagtatagtgtttaagaatctctctacagagacatcattaatcactcggttatctcgggtgcgtactgcgagtacattttcattaatttcatgatctccaagagtgatcatgtaattgacctgcatgttttgggcattgcgaatctttttacttacagactcactagaatcgtctaaggtgacgactaagcctaaacgtttccacgcttcctcgagctctttcgctctaggaatatggcgatcagcaactgtgatgatacgcacttgctcaggacttaaccataaggggaatcttcctttgaagttctcaatcagaattcctaaaaagcgttctatagaaccaaaaagagcccgatgtaacatcacaggaacactcttagttccttgagctgtggtgtattctaattcgaaacgctctggaaggaacatgtctaactggatggttccacattgccatgttctttgaatcgcatctttaacatggatatcaattttaggaccgtaaaaagcaccttctcctggacgaacaatgaagggtgtcccggactgaactaatgctcgatttaaggcatctgttgctagctcccatagagaatcatccccaatcgtatctttttctggacgtgtggagagttccaggtgatactctaatccaaatgtaccgtacagtgtagaaactaactgaagaatattcaaagtttcctcttcgacttgctctggagtaagaaatacatgagcatcatcttggtggaacgcacggacacgcattaaccctgaaagggctcccgaagcttcttgacgatggacatgaccaacttctgctacacgtagagggaactccttataactatgcaagcgggttttataatagagcatgcatcctgggcagttcatgggcttaatggcataatcttcatcgtcgatttgcagtgtgtacatgtttgctttataattgtcccagtggcctgaaacttcccataactgacgattcatcaactgtggcgttaggatttccttataacccgcagctgtgtgcagctgcttccaataacgaatcaatgcatcccaaacaatcataccgcgaggatggaagaagggcattccaggagaactttcttgctgagaaaatagatctaacttggcccccaaaacacggtggtcccgtttttttgcttcctcaatttgctctaaatgtgctcgaagttccttagatgtaggaaacgaagttccgtaaatacgtactaaagattctcgagaaggatcccctcgccaataagctgcagatgtgcgtaagactttaaacgcttttacatgagctgtagagggaaggtgaggacctcggcaaagatcaaaaaactccccttggctataggcagaaatttcttcattttcaggaagctcacgaatcaactctgtcttaaatggattctgtgggaattgtgctaaagcttgttgcttatcgccataagtaaagcgagaaatcgcaagcttttcatcaacaatttgttttactgtatcttcaattaacgggaaatcactttcgctaatggaaagattggcaaaatcatagtaaaagccatggtcgatgacagggccgattgtaggaattgcatcaggccataaacgcaatacggcttgggctagaagatgggcagaagtatgaagaaaaatttctcgtccttcgggatcttcggaagtcagaaatactaaggtgtcgccttcgtttaggtgggtggaaagatctctagggcgttcgttaatgagaacaccaatgaattgatgagaattttttaattgtttagcgagttccgctgctgtagtaccttcgagtacttcataatttttttgatcacaagttacttgaatcatcttgttccacgcctccatgttagggggactttcgttgttagcattttagtgttttttttgatcaaagcaagaagcttttttttataaaaaaacttttattttttaatacaagttccaaagcgccaggagatttagattggaactaataaaaacatcttttatactatctgcttaataaacattacaaactggtttgcatatgtcgctttttctagtttttcttacggcatttatttggtcttcttccttcgctcttagcaaactagttatgaatgcttcagctccgatatttgctacaggagctcgcatggtaatcgctggtgcgatcttggctcttgctgcatggtttcgaggcggttttgttggtatatcgaagaaaatattcttatatatcgtcctgttagctttaacaggtttctatcttaccaatatttttgagttcataggattacaaagtctaagttcatctaagacatgctttatttatggactctctcctctaatgtcagcacttttttcctatattcagctgaaagagaaagtgactctcaaaaaggttttaggattatccctaggcttggtgagctatatttgttacttaacctttggtgggggaggagacgattctcagccttggacctggcaaataggtcttcctgagcttctaatcttaggggcagcaagtttagcttcttttggctggactcttcttagacaaatcgaaaagcagtctacgttatcggtcacagcaattaatgcatacgcgatgttaatagccggaatgctatcaatcatgcactctgcagtcgtggaaccctggcgtcctttaccagtgcaagatatatcgcagtttctatacgcgactttggctctagtggtaatttctaatttgatttgctacaacctgtacgccaaattattaagaaagtattcttccactttcctttcattttgtaaccttgtcatgccactttattcaggcttttatggttggatattgcttggggagaagggagtctccttgggcttggtgttagctgtagccttcatggtggcgggctgtcgtctcatctaccatgaagagttccgacagggctacattgtttcttaaagtaaagccgctttacatgaaaaagctcggtatcaaaccgagctttttttgatcagatctctaattgtgattaattaaagatagcagatgttgtttgtgtttgagagtccgcaatattttgtagtgtttgtaaggcagtattaaatgattgcatagcttgctcttgtaattgtcctgcttgtcctgcttgctgaccataaaccgaagacatttgtttcaagacttctgcttgagcctctgcttgtcctgctaaccgctgatgatgggcgacttctattcctgtctgccccgcagaaagaccttcaacagccgctgtgagtccatgcattaattgactcatttgcatagaggaagaaagagcatttcctgcaaatgatgcaacacgcgctccctgagttttcactacgttcatacctctggagactttttcagaccagttaggtttatttaagacttcgccaaagagtcctcctgaagctttcgaagctccatcagaggccatttttgaagctgctgcggccatatcatcggttaggttcgctgcagctttggtggctgctgatcccgcagaactcgctgctgttgttgccgccttggcagtcgaagccatagtctgttgaacagaagaacttgcagaagttaaagctttggaagcagcacctccagcagctgaggcacctgtttctttggcaaaggaagcagattttaaagccgaggtagctccttttgcagcagagaaaatacccgctcctacagaaactgtaaatcctacaatgtttacaataccactaatcaaggactgttttgcctgtgcttctgtagctgatgcttgatggttcgcttgccttttaatagcttctccaatagcaggagcggattcgacttgtgaccggatcgcttggttttgtgattggaatgaagctttccaagactctccggcagcattggccatcaaggtcataactaaaccgaggagtgctaacgtacccatgccttttttaagtacaataccattgatggtctgtgcctcaggagtaggaaggctgggtgagtcataattattttgtcttaatcccttaggaccttgtacggcttgtgccgttgcagtttcacttgcgcttgctaccgaagttgaggatttagatttcccagatttttcgcttttttctcccttactacttttagtagttgaagatgtagcttctttttttcctgtactttgcgctgaagcgtcttgaatgagatcctcaaagcctccagcagcgacttctgcttgagccccttgctttgttacattcttagtatcgtgaccgctctgagcatttcctgctttttgagaggattgtgccaattgcgcagccaatgtgggatcctgacttgaacttccactaactcctgatgtcatagcaatacatgctcctttaaaaattattggttttatgtgcgccagcgatggctccgctgattgcggcatacgctttaaggatttgagcgcccagcttggtagctttttgagtcatttcattagactcgcctgtttgttttgaggcaattttacttgcctgttgccaaaattgagtgaacatagaaatcatatcagccgcagcctgcagttttccgacttctttctgaaattgagcgacgttttgttgcatctccgagagctgcatttgcataatccctttaccgagagcaggcgccgcaactacaaccccaaccccaaccgtgacccatttactggtaagagacgagatgactttcgagagcttggggaagttcttcgcaatcatttgagttcccttagcgaaaaccttagagattcctttagaaatggctttggcaatcgctttgactaaagttttgataaatgcttttattccagatttgacagccgcttttatagccgcggtgatcgcttgtctgacagctgtgataacagcttgtttcaccgcttggacaacagcttgaactgtaatttgtgttgctaccgtggttgcggcagcagctcctgctgcacctccagctgccgctgcacctacagcagctcccgcagcgagtccagcgagtccagctccgcatgtaaaaatagcagcaacaatagaaataactgtaatggcaacagaaaccgcgatcatcacagtattgacagtatccattgttccttcgagatctttagacttctgttcggcagccttcatctcttggtattcttctcgttctttatcgatttttatcgcttgcttttctagacctagtttatttgtttggtctgcttgtgcttgtgtacttgcatagttagataaggcagattttgtggcttctcccaatgtctgaattgctttagcaagcgcgagtccgatttcgataacctctgatcttggtgtcaccccgggcttggggagctcaggtgtttccaattttgcggaacccgaacttttccctgagagggcagcaacaacaaccgcttcgacttctttcatttgcgcggcactgaggctttgaagtgactctaaggtagactccatacttttgctcgcctcttcaatagaggtctgcatagcaatttttgttgcagtatttgatgctgtagtagcagccgctcctgatactccagtatcagcacctgccttttgactttctgaggattctttcccagcagcaactccctgttgtggagctgtttctgtttttgtagtcgaggaagttttgtcttttccagaagcaccagcaatagtggcatcgctttccatctcagtgtttttaccctgacgtgtttgctgtatttgcttcgtttcgttgccagacagcttatcttgttggggcacgccctggggtgtcgatgtcagaacttgagacatgatatttttttgattgtcaggtcctgaagaagatgaaatagacatgtttgtatcctaaggggtttgattctgcaaagggctttactcagcgcctttaaccatttgtttattaactacagtggttaggttttttaatccgtgtactactgaagataactcctttgcgaagttggcatcttcttgggcagaagggaataatccttgagttaactcttcgagatgtaaagattctagagttccagaaagagccgcgatgatgctattaatctgattcttgtcagtaagactggcaaatgtctgagctaagggaagctctttatatagatcagataccgcaagttctaactgctggatagcagcttcttgagattcttctggtacgcgctttacaggagctgccttagactgaactgccttttttgttttcttgggctttttattcatgatttctccttagaatcttactaacgtttctttccgcttttcttatttgtagttgttttgctttttcccgcaggtttttttgtcggtgctttcttagtttctccagccatctgcttctcaatagactgtttcataatttggcaacgttcttttaagattttgaattctgggttattcccacagatatccatggtgacgtctaagaaattgttagattcttcgggttgctgtagcttcaataagctatcagcaatgtagtaaggaggaattgggttgtcaggttgagcatcgaaagcaaggaaaaatccaaaagccgcttcattatataaatgcaattggtggtagcaggagcttaaccctaacatatacttgtagttctgaggttgtgctgctgccaataactggaagagtcctacagcttcgttgtacttcccttgagaatagaatgtataagctacagtatagatctcctctaagagatagtccgagagacctagaatctgttgtaggtctagtccattgctaagaccttcgaagatattgcctaaagcttttttaatttcttcttccgtaggtacgggatggacttgttctaagtcatcagcctttgctttcttttgagcagccagctctgctagacggcttcgcgtttttttattgaaagaggctgaaggtttttgaggttgattggcattacgaggagagggcttgctcatcgatctaattcctaaaataaaattattttgtatttatgaatcaattttaaaattaatctttttctaaaaacaagcctattgataataatatttttattattttaattaatctttttctaacccgttcatttttaaggaaaaatggaaattagacggaagctttcttgacattagctttagggtattttaatttgctggctcggaaatttaacgaaggcacctatgtctacaagaaggcctattcagttacttgatcccctgaccatcaatcaaattgctgctggtgaggtcattgaaaactccgtttctgttgttaaagaactgattgagaattccttagatgctggcgccgatgaaatagaaatcgaaactttaggagggggacaaggcgcaatcattatcagagataatggttgtggcttcagagccgaagacatccccattgccctccaacgtcacgccacttcaaaaataagagaattctctgatattttttctttaaatagctttggctttcgaggcgaggctctaccctccattgcctcgatttctaaaatggaaatacaatcttccattgagggggacgagggtgtacgtaccgtaattcatgggggagacatcgtttcttgtgagccctgtgctcggcaactaggaaccacagtgattgtgaactccctgttttataatgttcctgtgcgtcgtggattccaaaagagcatgcaatcggatcgcttagggattcgcaagctgatagaaaatcggattttatccacagcaaacatagggtggtcctggattagcgagggacatcatgaaattcagattgctaagcagcaaggatttcaagaaagagtcgcttatgtgatgggagaccacttcatgcaggatgccctcaccatagataaagaggcaaatggtgtccgtattgtaggggtgttagggtctcccagcttccaccgtcccacacgtcaaggacagaaaatctttattaacgatcgccctatagagtctttatttatttctaagaaggttggggacgcctatgccttgcttctgcctctacacaggtatcctgtttttgtgctgaagctctatcttccttcgtcatggtgtgattttaatgtccacccacaaaaaatagaggctcgaattcttaaggaagaacttgttggagattgtatcaaagaagctatcgtagagactctagcatgtcctcctggcatcttatgtcgtacgcatcaagaaatagaagaatctgattcggtgcccttacccatgtttcgtatgttggaaacaagcgatgtgcaagaagaagagagtgtagagtttgatcaaaatctttttgcatatagttcagaagatgtttccttagagaaacaagaatatacatctagaggacctaagtcccaaatggattggatatattctagcgacgttcgttttttaacttctttaggtcgtgtggtcctggctgaggatcttgagggtgtgcacattatttttacagctgcagcgcgaaagcacctgttttttctgtctttgatgcaagagaattctcgcatgtatcaatcacaagcattactgattcctctacgccttcaggtgactcctgaggaggcttttttcttctctcatcacggaagaacgttatgcgacttaggaatagaaatatcacaggtaggaccttgtgttttctctattgaaagtacccccactgtcattggtgaagaagagctaaaagaatggttattgctattggcagcaaggggctctactgatataaactcagaggctttaacagcattgatgaaagaaactttgacgcaggcaacgttttctaaacatcagcatgtttttgatgtttcctggctcaaattgctttggagtgtagggaaacctgaaaaaggatttgacggtgcacgaattcgtcggttaattttagactctgattttatggaaggataatcatatgtcacacgatcgtattttacgtgctcaaagagccctctcagaacataatcttgatgctattcttgtggaaaaaagcgaagatcttgcttatttcctgcatgatgaagcgattgcagggatcttattgatagggcagcaagaagtgatgttctttgtctacagaatggataaggacctctattctcatatccaacgtgtgcctttgacttttctcactcaggatgttgttgcagacttatcgctctacgtacaaaaacagaggtatcagaaaataggatttgatagtgcctcaacagtgtatcacaagtttgcacagaggcaagtacttccctgtctttgggagcctttagagtgcttcacagagaaaattcgtagtataaaatctgaagaagaaattagacgcatgcaagaagctgcagctttgggatccgcaggatatgattacgtattgacgttacttcgagagggaatcacagagaaagaggtcgtgagacagctgcgagctttctgggctgaggcaggagccgaaggaccttcttttcctcccattattgcttttggagagcattcagcgtttccacactcgatccctacagaccgtcctttaaagaaaggagatattgttcttattgatattggagttcttctgaacgggtattgttctgatatgacccggatgacggcattaggaactccgcatcctaagcttttggaaagctatcctgtggttgtggaagctcaaaagcgcgccatggctctttgcaaagaaggagtgctttggggagacattgatgcagaagctgtgcgtgtactgcgagagcatcacctggatacttattttatccatggaataggacacggggtggggagacatattcatgagtacccttgttctccgcggggaagtcaggtgaaactggaatctggcatgaccattactgtggagccaggggtctattttcctgggattggtgggattcgcatcgaggacaccctatgtatagataaaaataaaaattttagtttgactgcacgtcctgtaatctcagagttagtttgtttataaattaaattggatttagtttttaaatttaaattgaatttaatttgtttttataaattgattttttttgttttttaagttatcttataactttatttttaacctgcccctcactatgtaccagcttctttcgataggttatagttttgtgagtttcatcgctctgctttggatgctgtgttattcaccgaactatgtaacagatttatataggatttctttgagtgccgaggaaagcttaggggggattcgagcgtttcctcaggcagagagcctcctgggcggagcctgtgctttaaattttccagatctagaagagagattgcctgatttaaggaaagagctgctttttctgggcagtaacgatagaccagacgcttgtggtgggaagttttcgctacaactagcctcttcaaaagagtgctacatcgcggctcttaaggagagagtctatttgaacgtcaccaactcttctcgaggccctgtgtattcattcagccctaaaggggtacccacagagttgtggattgagtgcttttctgtgagcgtggatggtagagtagaagttaaggtgcgcctccaaggtttacataaggagttaatttcgaagccgcgagattgtgaaaccttatttttaaaccctccagctaataaactagattgctgggagattgcgggatttagagtagatgcaagctttcctgtaaaacaaaagatacgtcgtatcggtgtggataagtttctcttgatgcatgggggagctgagtacgcggataaggcgacaaaagaacgtgtcgattttgtttcctctgatgaggagaattatagtcggtaccttgctgttggagatgttctcctttgggatggcaactgctggcagacctgcggagagtttcaaggagcgagctcgcgagcgcctctttttgaggtgaagaggatcgacgataaggtcatgattgcggatctatggaatgtcgggggtacgcaacgtcagacgataagtcttgtgaaaggggtgccttctcctatcgaaattaacgaagtgatacgtgaaatcgagttcactgggatgcgctcatggtcaaagcctatcgttttggtagggggacaaaggctgattctttctcccgacgattgggtactaagaactgctaagggttgggagaaactttcaagggcagaccagattcaagattacgttacaggaaaggtaacaggacctcttttggtctttgaaaagttagaaaaggatcttcgagggtttgtcttgcgagggcatatgtttaatgcacagcgaactctcgtagagacaatcagtttaccgttaaaacaaggatttgagcctgctgtggcttctcaagaagtgtcttcaaacacacgtagcgcagcagcacatccaggggcgaccaatcgtgggggatcatagatggtttttttccgtaattctttactgcatttagttgccctatccggaatgctctgttgttcttctggagtggctttaacgatagccgagaagatggcttctttagagcactcggggagaggagcagacgattatgaggggatggcttcgtttaatgccaatatgagggagtatagccttcagctgagcaagttgtatgaggaagcacgaaagctacgcgcttctggaactgaggatgaagctctgtggaaggacttaattcgacggattggtgaggtgcgaggctatcttcgagagatcgaggagctttgggctgcagaaattcgtgagaaagggggcaatctcgaggactacgccctctggaatcacccagagactacgatttacaatcttgttaccgattacggaaccgaagactctatttatttgattcctcaagaaatcggagcgattaaaatcgcaaccttatcgaaatttgtagttcctaaagagtctttcgaagactgtctcactcagatcctatctcgcttaggtattggcgtgcgtcaggtcaattcttggattaaggaactttatatgatgcgtaaggagggctgcagtgttgctggagttttttcctccagaaaagatttagaggcgctcccagaaacagcctatattggttttgtattgaattcgaacgtagatgcgcataccaatcaacatgtcttaaaaaagttcattaaccctgaaacaacgcatgtagatgtgattgcaggacgtgtgtggatttttggttctgcgggggaagtcggcgagcttctgaagatttataattttgtgcagtcggagagcatacgtcaagagtatcgggtgattcccttaactaagatcgatccaggggagatgatttccattctcaacgcagcatttcgtgaggatctgactaaagatgttagtgaagaatctttaggccttcgtgtagttcctttacagtatcaagggcgttcgttgtttttaagtggaaccgcggcgttagtgcagcaagcgctgactctcattcgagagcttgaagaagggattgagaaccctacggataaaacagtattttggtataacgtcaagcactccgatccccaagagttggcggcattgctttcccaagtccatgatgtcttctctggcgagaataaggcgagtgtcggagctgcagatggatgtgggtcgcaattaaatgcctcgatccaaattgatactacagtaagttcttctgcgaaagatggctcagtgaagtacggaaacttcatcgcggattctaagacaggaactctgattatggtggttgagaaagaagttcttccacgtattcagatgctacttaagaaactagatgtccctaaaaagatggtccgtatcgaggtgctgttatttgaaagaaaattggcacatgagcagaaatctgggttaaatcttctacgtcttggtgaggaagtttgtaaaaaagggtgcagtccttctgtgtcttgggccgggggtactggcatactagaatttttatttaaaggaagtacgggatcttcgatagttcctggttatgatctcgcctatcaatttttaatggctcaagaggacgttcggattaatgcgagtccttctgtagttactatgaaccaaaccccagcacggattgctgttgttgatgaaatgtcaatagcggtgtcttcagataaagataaagcgcaatacaatcgtgcgcagtacggtatcatgataaaaatgctccccgtaattaatgtgggagaggaagacggaaaaagttacattactttagagacagacatcacctttgatactacgggaaaaaatcatgatgatcgtcctgatgttacaaggcgtaatattactaataaggtgcgcattgctgacggagagactgtgattattggaggtttgcgttgcaaacagatgtcagattctcatgatggcattcctttccttggagacattcctggtatagggaagttatttggaatgagttccacatcagacagtctcacggagatgtttgtatttatcactccgaagatcctagaaaatcctgtagagcaacaagaacgtaaagaagaagctttactctcttcgcgccctggagagagagaagaatactatcaggctttagcagctagtgaggctgcagcacgagcagctcataaaaaattagagatgttcccggcatcaggagtatctttatctcaggtagagaggcaagaatacgatggctgctagtattttatctcaggagcttttggatatccttccttatacttttttaaagaaacactgtcttctccctattgaagagagtagtgaggctattactatagcccatgctaccgcgacttcagtcattgctcaagatgaagtcaaattgttaataaaaaagcctgtgcgtttcgttctaaaagaggaatcggagattctgcagcgcttacagcagctctacagcaatcgggaaggtaatgtttccgatatgttgttaacaatgaaagaggaagatggcactacgatttcggaagaagaagatcttctggagactacggatacgatcccagtcgtacgcttgttgaactggattctgaaagaagcgattgaagagcgcgcttcggacattcattttgagccttgtgaggattctatgagaatccgctaccgcattgatggtgtgcttcacgatcgtcattccccaccttcccacctgcgttcggcattaaccactcggcttaaagtcctcgcaaagatggatattgcggagcaccgtcttcctcaagacgggcgtattaagatccatattggtggtcaggaagtggacatgcgtgtcagcacggttcccgtgatttatggcgagcgtgttgttcttcgtattttagataagcgcaatgtcattttggatatcgcgggcttgcatatgcctaagggtaccgaaatactctttaaagataccataacagctcctgaagggatccttctggttacaggacctacaggcagtgggaaaactacgaccctctacagtgtattacaagagcttaagggacctttaacaaatatcatgacgatcgaagatcctccagagtataaactgcctggaattgctcagattgctgtgaagcctaaaattgggctgactttcgcacgagggttacggcatttactgcgtcaagatcccgatatccttatggtcggagaaatccgagatcaggaaactgcagaaatcgcaatacaagcagcattgactgggcatttggtagtgagcacgctccatacgaatgacgctatttctgcgattccccgtcttctggatatggggatagaatcctatttgttatcggcaacgctcgttggcgtggttgcccagaggctggtgcgaaccatttgtccctattgtaaggtcgcttatactcctgagaatcaggaaaaatcttttctagcttctctagggaaagatacagaaatgcctttatatcgggggcaagggtgcgtgcattgtttccgttccggatataaaggaagacagggaatttacgaatttttacgcccgaatacactatttcgttcagaagtagcctcaaaccgcccctatcatattttacgagaaactgcagaacaaaacggattcttaccgatcttagagcacggcatcgctcttgctgtatctggtgagactaccttagcagaagtcttaagagttaccaagcgctgtgattagggagggcggatgcctcgatatcggtatacatatttagatcccaaagagcgaaggaaacgaggatatttggaagcccttcatatacaagaagctagagaaaagctcgcccaggaaaatatccaagttttggatattcgtgaggtcgccttacgaagaatgagcattaaaagtaccgagctcatcgtgtttacaaaacagctcctcctcctcctacgctctggactgccgctatatgaaagcttggtatctctccgagatcagtatcatgagcagaaaatgggacttttgctcacatcgtttatggaaactctaagatcgggtgggtctttatctcaagctatggcagcacatccgaatatctttgatcacttttattgtagtggtgtcgctgctggagaaagtgtggggaatctcgaagggtgtctgcaaaatattattgttgttctggaagagcgtgcgcagattaccaagaagatggtcggcgcattaagttatccttgtgtgttgttagtattttcttttgccgtgatgcttttctttttgttaggagtgatcccttcattaaaagagacctttgaaaatatggaagtcaaaggactaacaaaaattgtttttggagttagcgactgtctctccgcataccggtatctatttttaggatttgcgagtgctttgattaccgttggaattttgatgcgccatcgcattccctggaaaaagatcctagagaagctcttatttgctttgccaggaaccaagaagtttgttgttaaggtagcggtgaatcggttttgttccgtggcatcggcaatcttgaagggaggggggaccctaatcgaaggtctcgacttggggtgtgacgcaattccctatgacagactgaagaccgatatgagagatattgttcaggctgtaatcggtgggggatctttaagtcaggagcttgctcagcgctcttgggttcccaagctcgctatagggatgattgctttgggagaagagtcgggggatcttgccgacgttttaggatatgtagcccacatttataatgaggatacacaaaaaacgttggcttcgataacgtcgtggtgtcaacccgtgattctgatttttcttggtggcctgatcggtgtgatcatgttggcaatattgatcccactcacaagcaatatccaaacattataaagtgtgtactcagaggagtcggtatgaaaagacaaaagagaaagcagtccatcacattgattgagatgatggttgtaatcaccctcatagggattattggtggtgctttagcattcaatatgcgaggcagtatccataaaggtaaggtatttcaatctgagcaaaattgtgcgaaagtatacgacatcttgatgatggagtatgccacggggggatcttcgttaaaggaaatcattgctcataaggagacagttgtcgaagaggcttcttggtgtaaagagggtaggaaattacttaaagacgcttggggagaagatctgattgtgcaacttaatgataagggtgatgatttagtcatcttctctaagcgtgtacaaagttcaaataagaagtaactcttgagtaacatcatggggtctcgacgtaaacttaaacgtagctttttacttatagaagtcctgatggcgctttctttggtttgtgcagtgctcttgccctgcatcagattttactacgccatccacaggtcttttgaggaagatatttttaatttgcaattgccagccctgatcgaccactgctttctatctgttgaagaaaagatgcgtcagcaaatggcagaaggaactgttctcacctcagggaaagggcagacagtttctttagcatataccagtcaggggataggctatcggatcccttatggttacaatgtagatatccgtcaggaagtccgtggtgataatcttaagatgaaagtttgccttgccgatgttgttgtggaacttttcccagatcagaaacaagcagtatccgtacagagatgcctatgtgtaactctatagctatgaaaaagcaaaagcgtggctttgtgcttatggaattactcatgtcgttcactctaattgctttgttattagggactttaggattttggtatcggaaaatttatactgtacaaaagcaaaaagaacgtatttataacttttatatcgaagaaagccgagcctacaagcagctcagaaccctgtttagcatgtccttgtcttcatcttacgaggagcctggatcattattttctttaatctttgatcggggtgtttatcgagatcctaagctggcaggtgcggtacgagcttctctccatcatgacaccaaggatcagagattggaacttcgtatttgtaatattaaggatcagtcttactttgaaacacagcgactgctctcccacgtgacccatgttgtactttccttccagagaaatcctgatcctgaaaaacttcctgaaacaattgctttaactataacacgggaacctaaagcatatcctccaaggacgttaacataccaatttgcggttgggaaataagcctatgcaaccttttatctttactttactgtgcttgacatctttggtttctttagtcgcctttgatgctgcgaatgctcgtaaacgttgtgcctgtgctcaaactatagaacgtggagagaacttcttttccataaaacgctctgcttgtgctgaaatcgaatatcaagaaaaatctcgccacgcctcagcaattgaaagaatctcaaaagataaaggcaaagtcactccaaagcagattgcgaaagtagctactaagaaaaagcaaagataccgtttattgcaggttcctttttcaaggcctccgaataactcaaggtataacctctatgctttgcttagtgaacctcccgaatgctatagcgatacagcatcatggtatgctatttttattcggttacttcgacgtgcttatgtagacacgggaaatgtacctcctggatctgagtatgccatcgctaatgctttgataagtaacaaacaagagattttagagaggggagcgcagcttggacccgatgttattgaaactctaacattgcctgaggaacaagccgagattttttataaaatgctcaaagggtcgtcaaactctcagtcgctactgaattttctgcattatgaagagaaaagcttaggccactgtaagctaaatctgatcttcatggatcccctactgttagaagctgttctagatcatcccgatgcttatagggaaacgtcgctcctgcgcgatggcatttgggaagcggtgaagcgtcaagaacatgccatccaagaacatggccaggcagctgctttggagctttttaaaacacgcaccgacttccgcctggagctgcgagataagatgcagttacttctaagtcgatacgatttgctccccttattaaataaaaaaatgttcgactacaccttaggaagtgccggagattacttatttttggtagacccagatactaaggcaatttctcgatgtcgctgcccttcaaagagtattaaattataatttaattttaatatttattttaaatagttttttttgataattgtcttaataagtactataaaaaatatttctataggtaggaccatggcagacgagaccccgaaagagaactcctccaaagaatcgtcctcacaatttgactctttgaagcgtaaggtgaaagatttacactccaatcctaaagtagggaaatggaagaagtttctttctcatcgagcttgcgaagctatcggtggttgcttggtgctggttggtatcatcgctgattttatttcatgggctggaggactgtttattgcttgtggtgtggtcctaggttttcacgttgaaattcgtaaaatgcttagcaatctccagagctattcgattgctaatggccctattaagaatgcaattctctgtggcttgattttattttttgtattaaacatcccttcctttgcagtctcgtttattgttctctgtgtcattctttcttttattacaacagcaccgtcatgttcgacgtgttcgaaagatcattgtgacaaacatcaagatacttctaataaaccttcttaaaactactttttccctaaaggcaaaatgttgaagccctcctttcctcaactttttgccttgttttcaggcatgttcgtcgagagctcacaggctggaacgtatctcatgttttaagagatgcatccttttctatagtcttgaatttatagattcttagattacaaaagaatatgcgagagattccctaagataatccataaacagtgcgctaagattcgtaagtgagcgcatctccagataagagtcacgataagagcctaggggattagagtacttgagggttggaacctaggagcataatggggacttctttgaaccaagcaagagtgaaataatctatctgcttaattatgaaccaccacgccagggtgagaaagagaagacccatgaaagccttaagggcagagaggaggtagatgacctgaacttgaggtgccatacggttaataatccctaagaataggtcggacattaacatcgccaaagctgcaggagcactcagctgtatggtcatcacgagacagagctggcacatcttgatcatagtaatccaaatcggggcacttaagctcatcatctcggcaggaaagaaactatggatcggaatgacttcaagagtttgcaataacaaagagattacaatacggtgaccacccactaaccaaaaaataatagtcacgaagtaatggtataaaatgccatgcggagaggtctgctcaatggaaatcagggatgtcgcgccctctaaaccctgaatcccttgttggttagtgatgaaagatcctgccgattgtgcagcataaaagggaaatgctaaaacaaagcctatcacaatgcctatgatcatctccttcacaagtaaaacataaaagagattgttatccatgtaatttgtgatctgcgtatccgccaagacttttggaaagatgattgcaagccaagagagactaatcccgattttaataggggagggaaagagctttgctcctaagaagggagctacagcaaaaataggaagcagacgggctaataaaagaagaaaaactgaccaaacataggccggaggatgttgaaagatataatctaagtaagcagaacctaggttggaaaaaagctctggtagagagattcccataagctctttatttccatttatagaagttttggaaaatctgacctgcaaagcgtaaaatcatattgctaagccaccctccagagatcattaaggttccaaaaatcacgactagtttgactgcaaaagcgaaggtctgttcttggatttgtgttgcggcttggaagatcgcaaccataatcccgactatggaagctaagatgatgggaggtgccgaaacaatcaaaataagtaataatgattggtaggagtactcaaaaagaacagatttgaaactagttgcgaaaaatgctaacacggcacgtgtccttatttaaagctgatcataagcccttggagcagtaatgtccatccgtctaccatgacgatcaaaagtaactttaaaggtaacgaaatcgatagaggggataacatcatcatctgcatcgctacaagaacgttagcagtcactaaatcaataacaaagaaaggtagatagatcaagactccaatttcgaaagcattttttatctgacccataataaaagcaggaataatgattacaaagtcggaggcagtgaggtgcgctcgaatttccgaagggaaggttttctgtgagatcttgtaaaagctttgaatttgtgcttttggagtgttgcgaattaagaaagagcgcaaaggttctttagatttgtttaaagcgacaaacactgtttcagcaccttctgcagtgaagaggctttgaggaatggtattggcttcgatttccttgcgagcatctttatacatagccactcccgtggggaacatcacataaatagataggatgagtgcaatcccattgaggacttgactgggaggtgtttgttgtactcctaaggcgttacgtaataagactaaagtaatgataatctttagatacgaagtgagcaacatgaccaggaaaggcgatagggccaagaaaattaagatgatcgcttgcgttgtaatgtctggatacgtatctgagaaacttccatctgacagatggtctctagggagaacatcatcagcattcagtgggggcatgtaggaaggcactgacgatgcagcaacaggctgttgtactacgttcaaaggattagaattcgagggaggaggggtaggttgacaacgcgagggacaggagttttcatatagactggcgtcagcaaaacagcatgagacgctcagcgtaaaaaaacaaagggaaaatcgaaaaatggatcgcataatagtgaatacctttattctttcttatcctgatcattagataaagaagaagaatccgtggatgatgaagtctcagatggctcgtctacagggttcttcgcttttagtatagtcgagaaagctttttctaaggcatctaattgtacatcaagctgcgcattgatgatccctgcttcagtctcgataatgcaacccccaggagtaacatcaggttttgctgtaagaattaaggagtcagcatactccacgatgttcttgagttcaggacgacttttctcaacaagaggtaaatctttgggattgacagagataatgatatgtttattttgtgtgagctctttcaatgcttgagaaataatagagacaatagtttcaggatgtaattcgagttccttcccaatgattttcctcacactcgcaattgccagaggaaccaaggcctcgcgtactcttatgcgtagatttttagtttcttcttctaagaaagcaatttgcttgctccaggattcagatccctctttaaatccttgatctttagcttcttgacgaatttgtgcacacttttgttctgtctctgcaacataggcttcgctatcggcttttgttttttctaacagctctttggcatcaaggaaagcagagaaagcttcaggagataaaaccttcttatttggggagacatcatcatctttaaaaattaagctaaaaaacttcatctttactatggcgtagtatctttgaggctgatttacctcagaagagaaaacaccgctccttttattgtcgtgttatttttctatactttgtataaagctaaatctttacttataaagcttttatttcactaagactttcatgcattgttctaggcgggacttaaaataatccacatagggatggtcataccatgtttttaaagtctgctcgacgatatatgctcgaccgacatctaacctacgtagaaaataccatagaaaagaagcgttttcttttgttaatgctttacctaaaaactctaacccttgcttatgaacgaactgtcgtaattctgcatcagtagtccaagaagaaagaaaattcgtagtttctaaatgtttcatcggatgagattggcagtaggtaagaaagagtttctctgtaggggagagagcattcttcactcgttcaatcacaaccttatccagaatgtgcttcaactctttagcaatagaataaagacctaggcagttgattaaagcgatctttacaggacctgtatagtaaagtatagcatttgctgaggatgcaggaagaaagatttcttctgtaattccacaaggacggatctttttacttagcatatctagaagatagaaggctccgaaaggtgcacagcgatgtggggctatagagatgccaggcagtaagggtagaatttcttgaactaaaggctctggcaaccacgctaataattgaccttggatttcaggagggaactctttcatggcaatggtaatccatgaaggatgaattgtaggtagccaactcatcgtaaaagataaagattttaaagggatttcttcgggatgaggagattcaacaagaagatttttaggaagaaacctggagaggtcatcttccttggagtgcttcatcaagatgtctagagttccaaaagtgttggcagtcactaagcaccctcaatttcattgcttccttctggagcatctttatcactagagtctttatcactggtttccgcatttttgctttccccctgtgaatctgcatcttcttttttctctttgtcagcagctgctccctcggctttcttggcttccaaggcattctttgtatatggtgtagggttgaagaacccttttgtacctcccatagtcataatgagagtatgagttttccaaatgacccaaaggagaccacaagaaataacaaataaaatgagaatcaagacataaaaaatgagacggaatttggtgagcgaagacttcgcaagaataataccccaaacagaaacataatcgatttcttctgttaatccccaaggaccattaattgtaatatcactataagctgcgcgatcgctcactacagagacgttctctggcacaagtcctggaacagcacttgcaataaggcgcttaattttggaaaccataatgctgttcggattgtccaaaacccctcgatgcttaatatacacagaggctgttaaaggaagattatcttcattttctgtagtgaaggaaatctgtactgaggcatcgacaacgccatccatttttctaatcgtagaggccatctgttctgataagccttcttgataacggattttttcctgaagctcggaaggaacaagaccttgttttgcaaaaagatctaacaggcttgtccctttcatacgtggaagacccgcttgatttagaatggcaagggcctctgtgatttgtgctgacggaaccgcgatatcccacatttgctcagtagctgctccggctgtagccgctgcagcttgaggcaatttttgtgcagccacccctttgcttaccaaaagcaccacaatctcattcgcttctctgccaggaagaccgtgcacaattagagacctgctgttacagcttgtacagcacagcaatgtcattagaaagaacaagcaaaaagaaatagatcgacgaaccataatccacgcatacctttttattcaccataacaaaaggggggattagtgccaatcgcgaacataaaatggtaatccttgtcttctttttcttcaagccacgatattaaaaaatgatttcatacatacctctcggcatggtgttccaattatgaaagggatgtttttttgaaggtaagataaatgctctctaccttatgtgatatttttcagagttttctttcctatcgttttatgaagctctctacctttgttgcaataagagtaattcacaaactcccttacttaagtcttaggcaaactttttggtttgagaatccgtgttcattttaagcatcgttgttgcggtacctacgttacctttcgagttctttgatggtataagagttaggggtaggacgttatattttggatagtcactcggaccattgtggtttcccttgcctctattttgagatagaaatacatatgtttcgtgccaactttggcgaaatccttttatataaatataagagattcaaggttttattcatggctttgctttataatgaaggaaacgtactaccgcgactttcttcatgagaactatttgaaaaacaagaagagcatgtttatgaaaatttataaaactgcaggggagttttttttagcaaatgcaaaatggcccttggtaccggctgggtatcgacgtgttcgaggaaaagattttgttctatccccgctcgtggacttagtgattctatttccttgggtaaccaaagactcccgatattcaccttgcagcatgacattcacttgtatttgtaggagtatagtagagtgtattcctgttgtaagtacattatttggtatcggacgattttgtgctgtgtggtgcgttgaaggtttctcaggctctacgtttgataagatctatcatacaattgtcgccgttctaggaattcttggtttgggaattcttacgttcattttaagaattattttttctgtgcttatgttgcccgtctggttcttatttaagtgttattcttagcgtacaagatggcgggactgcagatcatagccactaggattcttgcagttttctcctcccctgcttcgaggtagaagcccagacatttcctcaagtctttagcaaagttgttgtatataagtacaagagttctagaattttattgatagctttgctttataatataactctcgtcttagggcttatttttattcataagaaatacttaggacaaaaggggagggtaattctgaaaatttatcaaaatgaagaagaattttttcgagcaactgaaaggtttccatcaataggggcggggtatctacgtgttcgaaacaaaaactctgtattatttccatttgaggatttaatgcttgtatgcccctcagtacctaaagactttccactttcagctttcaaagtaacaactaagcttatctattggagtgtattagagagtatccccgtcgtgggagcattttttttcagtataggaagactctttgctatgtggtgcatagaagatttcccaggctctattttttctagaatctatcataccattgttggtgttttaggaattcttggtttaggaatcatcatgttcattttaagaattatctttactttgcttacgctacccttctggctcataagttgtctaaaatcaagtgctgcttgaccaagatcgagtcccggtgattgaagacggtttccgatagccactaggatcactgaggttccttcctctctgagataaaaactcatatttttcgtgtaaagactaacaaatcagttttataggaatgcaaagattgtataaagatcgagcatcttggtcgctctactctacagtgaagcacgtgttttatcttgactgttagaaaagaaaatatttccagaattgactcttttacacgtagttgaacttagttctaggggatctaggttttatttatatttaataaaacaaaaggaaaaataatgtgcttataagaaaatctgaatcagaaggagctttttttgaagcaactcaaaattatcctacaatacagcaaggatatcagctggtacggattcgtgagcacaatctttctgtccgagcacattttgacttatctctatctcttgatgcatcagtccatcccgcggcttaatagatagggtattgaattctagatgcttatttctatttttaaagagtagatttctttcggtgtcttgtctaaatggaggctatcaggcgtatttatcaactcttcttttgagtgggccggctttggatagttatttgtaagcgtatctaaaattgtaattatttatagcgtacggaattgtttgttggaggggctaagactacggagcgcagttttaagaattttcctaacaagtttcttcatcttggtatcatcggttagtgtcttgtctggatgagaagatcgcaaggatgacagtttgaaaaagcgttagaatgtagtttttaagatgtgaatccatgatctttcaatatcaagattcgatgagatggatcgtactatgcttgttaagctgacgctttgtcttgtacagaagctaggatcatatcggcattaaaactcgagcgtacaaaaggtcctgcgtaaacaaaaagacccatagcttctccgactcgacgatagtaatcaaaagtctcgggagtcacataacttttgacttggagatgcttacgagaaggacgtaagtattgacctatagtgacaatacgaactcctatggaagccagatcttggagagtttgtttgacttctccttccatctcacctaatcctaccatgatcccggatttgattttaagatcggggaggtagttggcagcttgttctaacatgaacatagatcgggcataggttgctttgtgccgtactagaggcgagagcctcgctacagtttcgacattatgattataaatagtaatgccagaatctaacagggtgtggagagcagaaacattcccttggaaatcagaagctaaaacttctgtagtcgcttgagggagttcttcacgtaacttttgaatgatatcgactaaaccttgtgcaccaccatcctcaaggtcatcgcgagccaccatggtgattaccacatgcttcaaccccagttctttcgctgacaaagcaatgcgctcgggttctgtaggatctagcgcgggtggggttttagaatgcccaatattgcaaaaaccgcaacttcttgtacagacatcgccgagagcaaggtaggtggcagttttacgagaccaacattctgctcgattggggcagagagcttcttcgcataccgttggcattcctgagcgttttattgtagcgtccgtagcatgaaatgcagaaccttgtggtaagggcctctgtaaccacttggggaaacgctcgggaagctttttccgcactctaggttggtctgtatttaaagttggtctacatttcatgacttaggagggaagtgtaaagggtgatttgtagcaagtaaagcaccttcagcccaaacttcagagagtgtgggatgagcatgcacggtttcatatatgcaaggtagggtcagctcattgcggatcgctaaggtcatctctccaattaatgatgaggcgtgaggtcctatgacataagctccgagtatttgctgggtaatttcatgactcacaatagcagcaaaaccatcagatgctcccaaagcaacagcttttccaatcgctttaaaaggaaatttggtgagctttgcaggaagattttgttgttctgcttcttgtagagatagacctaccatagcaatttctgggtgggtaaagatcacagaaggtatggcagaataatccataacttcgtgatgtcccgaaatatttttcgcggcaataacgccttggtgcgaagccacatgagcaagtagccactttccagtgatgtctccaatcgcatagatatttggaacattagtgcgcatggtttcgtcaacaggaatcacgccacgatcgtcccggatcactccagcattatctagccctatacttgctgtattaaattggcgaccaatagccaccaagacataatcaaactcttccacttgatcgttcacagtaatgcgaacttggttttgggattcttcgattgcagagatcgaggctttggtaagaattcgaattccttgtttcgtaaatttattcgttacggtttgagaaacttctttattgttaaccgcaagaatatgatccaaagcttctataacggtaatctcaacgcctaaagtgtgaaatagagacgcaaattcacagccaataacgccgccaccaataatagcgagctttttagggaggacttcaagttctaagatccctgtggaactcaaaattctagaggagaagggaacccctgggaaaggacgaggctcggatcctgtagctaggataatatgattggctttgattatagtcgtgtcttggccaataactttaacttctgtagaagatactagagatccggttccttttaagacagtaatcttgttgctgcggatcaatccttctaatccttgacggatcccctggacgactgtattttttctttttgccatcgcagggtaatcgattgtataaccatcaacatggatgccgaactgctccgcatgcttaatgtgagatacaacattggctccagcaatgagggcttttgaagggatgcatccgcggtttaagcaggtccccccagcctggtcttcttcaataagagcggtccgtaattttgattgcgcagcagtgattgcggcaacatagccactaggtcccgcaccaataacaacacaatcaaattcttgggtcatattctcactcactgtaatcaagatttcaaaaagaaccccccttcataaatgcatgcatctcattaagaagaggaccctgtgcttattttagacctaaagattaattttcagcattgcttttttcttcgctgattctgtattgaacctcgcctatatatcccagaaaaagcaaacgttccctcggtaaatattgttttcttttttaatacccagaagtatacttgcattaatggcattttagcgacctaagaggtcgtgatttcataattgacaagaacgtattcgttataaacaagcatgtttaaatggatgagtttatgggggaaatgccataacttaaccctacagagggcatagttggatagcaattgacgaggaagaatgtatttctcctcatgatcatgaaaaaagtgaaagatacctatgccatttgctaaagagacagaaatgcaaaggacgtgttggaagtgtgaaggcagtgtatctatgcacgtgcctcaatgtccctattgcagcgcctttcttcaagatcctccagtagcctcaggagggttttcttcttgccacatctcgttcccagaaggagcttctaaagaagaagccgaagacctatttgccgtctcttcagaagattgggaagccgtgcttggagatcaaaaccctactcaagaaacgaataaacaagtgatccctgagtggacatggttacaaagttggcctcttgcagccttatttttaggcataggcttgctagcgtttgcctttctgattcttcttttctctacagacagtggattggttttgacttggcctaaaaatcgggcctatttttacggtattataggtgctgcagtcgcctatcgtggataccgtaaacttcctctttaattagcactaaatacaatttcttcgttaggaatcctcagggggaagcacacctgtatcatcttctacgggtgcatctacaggggactcttcactgtctgaagttccatgttcgtctttgtaggatagtatagtgaggagatcttcccgattcaacatgtgtaggatattagaatcttgagaggcaatgaccttatccaataagcgaattttcttctcaattaaataatggatgcgctcttcaagtgtatcttcagtaatcagcttatagataaagactgtatttttctgaccaatccgatgcacacggtctagagcttggttttccttggcaggattccaccaacggtcatacataatcaccacattgcctgcagtcaggttaattcctgttcctgccgcaagtaacgacccaacaaacacctgacaattaggatctgtagtaaatgtttcaatttcttccttccgattcagagattttccttgaatcgaagcatacttgatcccaatttcctcaagatagagagtaatgatccgaatcatgtggatatattgcgagaatacaacaactttgtatccagcgtttaaagattccttaagtagcttaacgaaagcattccactttccagattcgtaatttttatattgatccgggtctttgaaaaatactgcagggtgatcacaaatctgcttgagatgatttaagagagcaaaaatgtgtaagaaattcgtagcaggttcttcgggagtttcaagcttttgaatatgacttttctctctttgcaaggtcgccatatataacttctcctgatccggagacaacgaacaagcaatgatagattcgaccttatcaggaagctcgggaagtaccagtttttttgtccgtcgcaagataaaaggacgagtcaactttaataaaagatcctgggaggggataatctcttccaattcttcagaagaacatcgtttggtaaacaactttttgaatagagcgtcagagggaagataattgggtaagataatgtctaaaagccctttaaactctaagagattgttctctatgggagttcccgtaagtcccagcttcatctgagcgtctatccgacagaggattttgtgaatttggctactcttgtttttagccatgtggatctcatcgaaaacgacaattgtgaatgctattttgtaaaacttatcgtagttttgtcgtagcgttccataagaagttaacaagatatcagcaggaggtagctcactcggtttgtttggcccatggaaagaaaaaatactcacgccaggaagatgattacttaaaatatgctcccagtgtggtaacacacttgttggacatacaattaagaatttcgggcgcgctgagggctgtgaagactgaaatacaatatctagtaaggctgtagcttggtgagtctttcctaatcccatttcatcacagagaagccctgagagtctgtgattgtataagaaccacatccaaagtaacccgctgttttgatacgggcggagctggtggtctgaagaaaagagattttgtggaatcggaggtaaacacgctgcttttaactgtgagaaaaattgcaagtcttcgggattggctatagtatcatcagttactgatagtggagctagagcatctaatttaaagacgtcagtaatattcgctatgacagtgttctcagcgatcacacatttctgcgtagataggaactgttttaaaaattgaaacaggttttgtttcaaatctaaaaagccagcctgtgtaaatagaaaagtatgtttacttttcaatccttgtaaagcgattcctatggggacagatccgaggtttgtcttcagctccaattgcaaatggagaggagaggcaggatgaggcctatgaatcgactggatcaccaattcataactttctggagggcgtgtctgcggatttggaaataaaatacgctcatgctgcgcatactgtgtaagaaactgtgggacattttcaggaggaatgactctaggtagaaagcataacccttgtaggggagtgggaatcaaagagaatcctatatcttcgcgatatagaaatacaccaaatagccaacaacggctttcccctaaaccaacaagaataggcttgaggtcaagtccttttccacgagattgcctgtgaacttcaataagaaggtcttttaaattagggggagaggaaaagaaattggggagacgtcgtagtgccgcatcgttctttacaatgaaagcagggatgtcttgaggttctacaatgagcccatcttgaatcggcaaatcgtttttcttctctagaaagaaaccttgatttgtatagtaggtccatgtcccgaaacgtatttctgtagaagagggatctccgacatcatagtggaataataaaacaccttgttctgtgacattataagtaagatgaccttcgggacgttcgtttataaatgtttggaaaccgggctcttgaattagatgccccctctcattgagaaagtcttcaacctgttcggatttaactataaacgcttgttttggagatagcatccccacgacttgcatcagacctttcgtaggactatagcaatagtttgggtaaatgagactgccattgtctaaatccccaggagtgacgaggtaagcagaaaatgagaaggaagcgtcacgtagtagacggatatcatagcgtagtcgatattctagagaatcatagcagagcaaagaaagcagctgatctttgaatttatcagcgagcaaaggaatcgcatagatgggaagggctatggctttagggcctgtgatcatttcatgcgtttttgcaacgtattctacagaacctattctagtcttaggatgattctctctgtcttttttatggataacaggacttaatgtgaaatttaccttagcttcttctgcgcagaccgtaacatttgtaatactgatgtcgtgagatacattctctaaagatgtatgcgcgagttccaacttaggaaatatgtcttctaatgtaggaaaatccaagatttccgctttaaagaccaggccttgccattgaagagaaaaatgagaaggaaagccttgagaattttctcctatcgtaagctcagccccttcttcatttaagaaaaagaattttttagcagtgcgatagagagcggacttcaagaaagtcttatttgtaaatactgtaggttcttcagaagcatgaatggtgcggagccaatcttggaatacttcctcggacagacactctattgttaacgtgatatgtggggattctagtgtataaaccatctctccttgagcttgtaatggaatcgagtcgaggaaaaagtgagagaagacggcataccaaaaggaatgacggaatttatcgtgtaaagggtgcaatcctaaagcgtcatagacagcaaaatatgcagtcataaggtggagacaacactcaccgtcaggacaactgcaagaagcaaaagttagcctatcaatatcttgaagttttaaagtgcttaaccaatagccctctggagcttcttcatcaggaatgcgtatggtgtaactatcctcacaaaagtctacaacgatctccttgcgatgtttaaggagatgttgcatcgcatcctgtcgaaagatggctaatgcttctaaaaccataatattatgctagcaacccgtatgttattttaattcactaactttaaaacaattgtaagagagagggttaaataaaacaagactggggagtatcggaaattccataacttgtaggcaatgtttccacaagccagtacaatcaaagctggatagctaagttgtagcaaaggcaagagtaggtgacttatagtttcaaaattcaaaatagaaattaaataggtggggataagagtacaaattactgctgaagcatagttcagtttcttaaaggaaactacacgagctagaaaatctgcaacaatacctactaaagcaatttccgtagttagacaggcaatgaaaacgctgactcctgcgagaatgctatttggccctaatgcaatcgcagagatccttcccagaatatgacctttacttacattcacaagtaagcccgcatgacgtgcagcagataaaacaaatccaagataggtcattcctagtaagatcgcagcaagaaagaaacctaaagctaaggaacgcttattttttttgctaataccttgaaaactaagagggatttcttcctctgtaggatgtttctcttcagctacgagctgacgtagagagatcaaaactatggagcagaagaaaaacgctgcaagtaaatccatagtattgaacccttcaatgaatcctgccaaccaagcttgacgtgcgttcggaataaattcttgaaccatggggtgggtaggaatcataaaactgcggatgatgacccaaagtaaggtaaccaacataatcgggaaaaatacagatcctagccattgaattaaacggctgagcttgcatgagaagatatagataagcacacagcaaatcgcactaaaaataggcaaagagggaatgaaagcactcttatgctcggatagtgaaatcaatgtggcatgagatactgcaatggctcgagggattccaccgaaggggcctatcaaaagtataatagccgtaataaaaatcatccctggaattcttcctatcgagaaaaagaacttctggtagtctccagaatagaatagcatactgactagacctaaaagaggaacgcatacagcagtaagcatcatgccgaaataggcagaccagggatgcgcattgtagtggtatcccagagctaagggaaagacaatattgccagctccgaagaacatagcaaaaatagatcctccaatagaccaaatggacaaactttttttatcatttgttttatgagatgcgttttttttcatcttttaaataaagtagagatagtaaagtgctgagtgaatgagtttaaagaatcatgatcttagaaatcaaacgattttcagtagttagtttttattgtactgtgggacaaaaggtagagttacgaattcttaaaaagctaacaactctaaatttatacagttttttttataacaaagcgattttctaagtacgggtactatttgcttcttttgcaagatatgaacatatagggcaattgtcaattttatgatgtaaagcaggacaatactgtcgtgcataatagatgagttgcaagtgcaatttcggtgtgttctcatggccaaaaaagcgagccagatccttttcagcagcggaggggctttttttttcagaaattttccatcgctgcgctaaacgcaaaatatgagtgtctacagggaatgtaggttttccataggctatcccaagaaaaacagaagcggtttttctgccaactcccggaagttgtgtgagaagagccatgtcattagggggttctccatgaaaatcacgcactaaaatttgagataattgataaatataggcggactttctctctccaaggccacaaggggcaatgagctggtatagcttccctggaggcaaatctaaaatagattgggcgtctggggcttttgcaaagagttgtggtgtcacggaatttactgctttgtccgtagaattcccagataagagaatagcaataagtagttgaaagggagaggaccacccttctaaagatggttttggattgggaaatagcgcgttgagtgttctgagaataaattgcttcatggtgagctattttccaatgcaaaatttactaaaaatttcccctaaaatactttcagtaacttctttgccagaaagcatcccaatcgagtgaagtgcctctcttaactccaaagcaatgatttctggaggttgcagatagaggttttgctgcgcttctttcagacagcgagccacctcttgtaagatcatgtgatggcgagaagaaactaaaaacactttagaggtttttccagcctcttgtttttgcatccattggattaaagcttgtttcacttgagtaagtccctcaccagtttttgctgagatcgcaaattgagggagcgaagtgtcaaggaatggaggaggggtgaggtcagctttattccataggaggaatgaaggttttgtaaaaagaattttaggaagatcttctagaggttgcgtcgcatctattacccagaggatcccatccgcttcttccatagcagaaagagctcgttcaatgccctctttttcaatgtcattgtctgttgttctttgtcctgctgtgtctagcagtcggatgcgtttgccttgcaagagccactgctcctctaagatatcacgagtggttccaggaatatgtgttacaatcgcccgatttttctgaagaagcgcattgagtagggaggatttccctacgttaggtttccctgcaaggatcaaacttgttccctgagcaagcctctgcccctcatcaaaactggaaataaaatcttccacgatatgcagagcattttgaattttttcttgagggacgaggaggtctggttgttcttcttcagggaagtcggctaggacttccaaaaacgccaatgcttcgataatcagagtatgtatttcttgaattttcttagaaaaatttccttgaaaatgcgtttgagcaatccgaaaggcgtctatattttccgcaacaatgagattttggattgcctctgcttgaaccaggtcaatttttccatttagaaacgctcgttgagaaaactctccagggagtgcaggacgggcgcctaaagcaatcaaagcgtctaaaatttgggagcaagcgaaaaatcctccatgacactgaaattcgactacatcttctccagtgaaggagcgaggagagcgcattagaagaagaagagcttggtcaattaatgtctcttcaaaaatgacttgtccaagatgtatcgtatgggaggcaaagctagccacagatccagaaaaaatacgatcggcaatgacaatcgcttgtgggccagagagtcgtacaacagcaatacttccttcccctggaggagtggcaatggcagcaatggtatcgtgctttagcataaaaatagaaaagttaaaggaactttcggatagaataccaagttttagattaaagaggtgaaaggagtttggataaatattaagactaattcaattggaatattttcattaatctttttataatttctttttatcgtttctagaggtcttgtgcagaagccccaatatattgatcgaatcactaaaaaaaaagtaatagaacctatattttatgaaaaaacaatgctcttcctatacaactctaagctagggaagaagctctcagtatttctatcaacacaccccatcttttctcgaatttatggctggcttcaaaggtgttcgtggacacgtcggcaaattcgccctttcatgaatcgatataagatttctgaaaaagaattgacaaagcctgttgcagacttcacctcatttaatgatttttttacccggaaattgaaacccgaagcacgccctattgttggtgggaaagaggtattcatcactcctgtggatggacgttaccttgtgtatcctaatgtttcggaattcgataagtttattgttaaatcaaaagcgttttcattacccaagcttttaggagaccatgagttaacaaaattatacgctcatggcagcattgtttttgcccgccttgccccctttgattaccatcgattccattttccctgtgattgccttcctcaaaagacacgttgtgtgaatggagcgctgttctctgtccatcctttagctgttaaagataatttcattttattttgtgaaaataaacggacggttactgtactcgaaacagagcagttcggcaacgtcctctatttagaagttggagctatgaatgtaggctccattgtacaaacattttctccgaaccaaacctatgctaaaggtgacgagaagggcttttttgcttttggcggctctacagttatcttgctctttttgcctaacgctatacggttcgataacgatcttttgaagaactcacgtatgggttttgaaacacgctgcttgatggggcagtcattaggtagatctcagagagaagaaatttaaagactttaaagactttttttggtattgcaaagagagataaaagtcaaaaatggcgaattatgtggttagtcatcttgtgggctctagctgcaagtttagcaatagcgctggtcgctaaaggttattaccgctttgtttattttcgtcgctatgctgtgcaagttatacgagaagtacgcctaagtatggagctcaaagaatgggcgcttgcagaacagcaactcctacctattttaaaaaaacggtcgtatcgacggcagtgtttatttgaatatatgcgcattctacgcaagatgcagcgtttcgaggaatccgagaaactgcttgccgaagcgaagaaattgggattgcgcggtccctattttttcttagaaattgcctataaagcctacaggtttggggcttttaaagaatgtgcacaggcgtttgcttccgttcctcaagatttgtttgaagaagaagacgctgcaaaatatgcttcagctctggtgcggttaggcgatttagatgctgcctgcagtttgattgaaccatggatttctcccctatctcaccaagaaacttttgtgactatggggcacatttatttcacttccaagcgttataaagatgctatagatttttataatcgtgcgaatgctttgggagtctgccctgttgaggtcacctataatttagcacaagcgtatcgcattacctcaagctatgcaaaagcaggcaaattattccgcaaactcttatcaaatcctgtctacaaagaagaagctttatttaatatcgggctttgtgaacaaaagctaggcagaccagggaaagctctacttatttatcagagcagtgatctttggtctcgtggggatgccttgctgatgaaatatgcagctatggcagctatggatcaacgagattatgtattagcagagccctgctgggaattggctttgcgctgttccacatttgctaaagattacaaatgcgggctaggctatggctttagcttgtgtcgattacgcaagtatggagacgcagagcgtgtgtattgtaatctgattcaaaatttccctgaatgtttaacagcgtgcaaggctttggcttggctttgtggagttgggtatgcaacactacttggttcagaagaaggcttgatgtatgcgaaaaaggccgtagaactcgaccatagttgtgaaactttagagttattaagtgcatgcgaagcacgttgtggaaattttgatgctgcttatgaaattcaatcgtttctttcttctcgagatacctctttgcaggagaaacaacgacgttcgcagattttgcgaattttacgtaaaaaactacctctcaacgatcatcatattgtggaagtggatgctctgcttgccgcttaaatctgatttttttaaattttttattctatggactacaaagccctcgtggctcgaagataacaaaaagcagaaatcagcttcttgggaacttttattcgttttattaagtaagatcgagtatggtattgagaaacgttctcgtaaaagatggtattctagtaattacagtgaattaaacgacatatgttaggttttcttaaacgcttctttggttcctctcaagagcgtattctaaaaaaatttcaaaaacttgtagataaagtgaacatttatgatgaaatgctcacgcctttatctgatgatgaattgcggaataagactgcggaattaaagcagagatatcagaacggagagtctcttgatagcatgcttcctgaagcttatggtgtcgtgaaaaacgtttgtcgacgtttagcaggcaccccagtcgaagtctccggataccatcaaagatgggatatggttccttatgatgtgcagattctaggggccattgctatgcacaagggatttattacagagatgcagaccggggaggggaaaacactcactgcagtgatgcctctgtatttaaatgctttaacaggcaagccagtgcatttggttactgttaacgactatcttgcacaacgagattgtgaatgggtaggatcggtactgcgctggttaggacttacaacgggagttttggtttcaggaactcttttagaaaagcgtaagaaaatttatcaatgtgatgttgtctatggtacagcatctgagtttggttttgattatttgagagataattctatagctactcgccttgaagagcaggtaggtagaggatattactttgctatcattgatgaagtcgactcgatcttaatagatgaagctagaacacccttaattatctcaggtcctggagaaaaacataatccagtctattttgagcttaaagaaaaagtcgcaagtctagtgtatttgcaaaaagagctctgcagccgtatcgcattagaagcacgtcgcggcttagatagctttttagatgttgatattcttcctaaagataaaaaagttcttgaaggcatctctgaattttgccgcagcctttggttggtaagcaaaggaatgcctttgaatcgtgtgttacgtcgtgtacgtgagcacccagatcttcgtgctatgatcgataaatgggatgtttattatcatgctgagcagaataaagaagagagcctagagcgtctttcagagctctacattattgttgatgagcacaataatgattttgagcttacagataaaggaatgcagcagtgggttgagtatgctggaggctctaccgaagagttcgtgatgatggatatggggcatgagtatgctcttatagaaaatgatgagaccctatcacctgcagataagatcaataaaaaaattgcaatttctgaagaagacaccttaagaaaggctcgtgctcacggattacgacagttattacgagcccaacttctcatggagcgtgatgtagattatattgtccgcgacgatcagattgtgattatcgatgaacatacaggacgtcctcaacctggacgacgtttttctgaaggcctccatcaagctatcgaagctaaagaacacgtcactatccgtaaggaatctcagacgcttgctacagtcacgttgcaaaatttcttccgtctatatgaaaagcttgcagggatgaccggaacagcaattacggagtctcgagagtttaaagaaatttataatctttatgtcctccaagtacccacgttcaagccttgcttacgcatagatcataatgatgaattttatatgacagagcgtgagaagtaccacgctattgttaatgagattgcgactattcatggcaaggggaaccctattcttgttggtacagaatctgtagaggtctctgagaagctgtctcggattttgagacagaatcggatagagcatactgtattgaatgctaagaatcatgctcaagaagcagaaattatagcaggagcagggaaattaggtgctgtgactgtagctacaaatatggctggtcgaggcacagacatcaaactagataatgaagctgtgatcgtaggcggtctccatgtgatcggtactacacggcatcaatcccgtcgaattgatagacagttgcgtgggcgttgtgctcgtttaggagaccctggcgctgcgaaattctttttatcttttgaagatcggctgatgcgactattcgcctcccctaaattgaatacccttatccgtcattttcgtcctccagaaggagaggcgatgtcggaccctatgtttaatagactcatagaaacagcacagaaacgtgtcgaagggagaaactatactatccgtaagcataccttagagtatgatgatgtcatgaataagcagagacaagcgatatacgctttccgccatgatgtcttacatgcggaatctgttttcgatcttgcaaaagaaattctatgccatgtgtctctgatggtagcatccttagtgatgagtgatcgtcagttcaaagggtggacattgccaaatcttgaagaatggataacctcatctttcccaatagccttaaatatagaagaactcagacagcttaaagatacagattctattgctgaaaagatcgctgctgaattgattcaagagtttcaagtacgctttgatcatatggtagaagggctctccaaagctggaggggaagaattggatgcatctgctatttgtagagatgtcgttcggtctgtcatggtcatgcatattgatgagcagtggcggattcatcttgtagatatggacttactacggagtgaagttggcctacgtactgtagggcaaaaagatcctttgttagaatttaaacacgagtctttcttactgtttgagagcttgattcgtgatattcgtattacgattgcgcggcatcttttccgtcttgaactgaccgtagagcctaatcctcgtgtcaacaacgtgattcctactgtagctacgtcttttcataataatgtgaattacggtccgttagagttgactgtagttacagattctgaagatcaagattaagaaataacctagaaggaggagtccttctaggtatttgtttcacaggctacatagtttttatttttaaataaatggggtccattctgaccaaacttggtcattatagtagcgaatccagaattttctgcgattgccggctatgaggaactgggcatagtggctcagtgtattgtttgctatacagaaaagaatgtgcttttggttcttggagttaggaaaatccttaggggcgttgagcaaagtatcaacgtttgtagtaaggagagactgtgtttttaggagttggttgcagtcgtattcaggttctgaaattgtcttcagtgcaatgttagaccagggagacctacttattgttcttggtgtatagtatttttaaatacagattcaccaagaacaataagtaggtctccctggtctgtattttcttcaacatacaccccagtttcttgatatttgtctagtgaagctgcttcttcagagttgtcaagtaagtcttcgaaaatctgatcgtggtcggtgtcgggcgtatcgtattggtcatagttcatgactttaaatctccaagaaataattaatttatttttatttcatggtaataatattttttattattttttaacaaattaattatgtctttttggtttttctttaaattctaaatcgaaaggtattccatataaattaaacgacgattttaatgtgttttttaaataatattcataatgttttgttaatagagactttgcatttataaataataaaaactgcagaggtgtcgttgtcttttggattgcataatagatcctcaacctgcgtccttgaatcacctgaggatggtttctatgtagagcagaagcaagagttttatttactatcggtgttggaactttattcgatactacgtgatgtagttcatcaattgcagagaagatctttttaagattgcgtttcgtagtagcagagatacaaagcattttagcttgtcctaaataaggatcagtagcgcgtagatctttgcagtaatgctccatgcggacttcttcaagtaaatcccatttgttaattaatatgatgtgaggcttttttcgtttagaaattaaagagaggatgcgcttctcataagaagagagtttttgtgtagcatcaatcacaagaagacagatatcagcacgagaaatagctttttcagttcgagatgaagaaatccattctatggaattcttaacgcttttcatttttctaagacccgcagtatcaatgaaaagatactggcggtccttatgggaatacagaatatcgatattatcacgtgttgtcccaggagtattatcaataatacaacgctcttcattgagaagaccgttaataatagaagatttccctacgttaggacgtccgatgagcgctatttttaatgtcttgggagcttgctgaggagactctgggatagtgcagggttcttcaggggagaagccttccgtgaatacttctgaaaaatcagggaatgtatttgaagggagagccgcctcagattcttcgtgttcatctacagaaagctcctcaaggccttcttcttcttcttcgcgaggttctggtaggttggctaccaacttaattctttgaagaagggtatcaatgtgcttatcgtgagctgttgaggtcactacaatatctcgaattcctaatttataggtctcatgaatttgtaattcctcttggcgactgtctgctttattggcgacaaggatgagaggtttctttaagggaaggaggagtttggctaggtgagcatcttcttcggtaataccacagcggatatcaatgactagcaataggacatcagcttccttagcgccggtgagggcttggttatagatatgcttttggaagtaatcttcagaattgtgatcaacacctccagtatcgatgacctgagcaggaacaccaaacgcatggagctcgccgtagaggcgatctcgagttgtcccctcttgagaatttacaattgctaaagagcgtttacatagacgattgaaaagtgatgactttcctacattgggtcttcctaagatggctatttttagcataatcgtctctattctattttttcagtaattaatgagaaaataataggagttaaaaaattaaagctaaagagataaatttctaagggttgtaaaagtaggattctatttaaattaatctacttccaaaagcctttttcttgtaaaagcaataaaattttttctttgtcgagacattcattttctatagagagaatctcagcttctctgagtagatcgccaagaagtcttccgggagagatgcccttagctatcagatcaggagccgaaacaacgggggaggatgtttttattcttaatatgaattgctctaagcgtgattcgagttcttgcactcgagagataaagtgctgctgtctgctcggatctttttgtagagccgagaagagctccaaaaatagaggtgctgtcggagacgctaggaaatgcgcccaaaatacacgattgccggattggttttggaaatgagggagtgcctcgtaccaagattctattaatttcaattctttattagaaattcgtaatcttccaaacgctactgttgcggcttcctcactgaccccttggaatagaggcagtaaaaaaagaatttcagggaaatgtgttggattaaacttacgggcaaattctatggttgttcttaagagactgtagggaatatcacgtagttcagggaaaataaaaattaagactttaagcttgagcagaagagagagggctccataaggctgtcttttaagcattttttttagctcttgccagattctctccggggatacggaatttactaatgccggggcttctttaataatggcgcgttctgtagttgggtctagggtgaagccgagggaggaagaaaaacgtatggcacgtaggatacgcagtttatcttctgagaatcttaaacgtggatggcctatagctcgaatgactttcttttcaatatcacgagttccttcgacaaagtcgaaaactttgtcttcaaaaggatcgtagtacatcccgtttactgtgaagtctcttcggagggcatcttctcgcatagaagaaaagatgatacgatcgggatgccttccatctttgtattcaccgtcagagcggaaagttgcaacttcaaataggcgtccgtcctgttttactacgatgataccaaaggcaacaccaatactgatgacgtctgggaagatcgtagatacaatcgttggggatgcattggtagctatgtcaatatcctcgagagggcgattcattaacatatctcgaacacaaccaccgacaaaatatgcctgatatcctgcattacgtagtttgataagaactttttttgcagcttctatggcaattgttgtcatgacacccctaaaataggaactaaaaagagctaagcgatagcttctggggtccttctgataattattggcgctttattttctgcgatagtgtcttcttggatatgaatagcttctactgtaggatctgaaggaatttcaaacataaggtctctaaggagattttctaggatcatccctagagcacgagctccagtttttgcttgcttggctttttttgctatagcatatagggcttcttttttgaagactaacttgacgttttcttctgcgaatagctccatatattgtttcacaatcgcatttgtaggttctgtaaggatggctacaagctcatccaaagaaagctcttcacagtttacaatgcagttgaatcttccgacaaattcagggatcattccgaaggcaatcaggtcttcggtttcaactttagcaagtagatggtctctggttttttgagagaggtctgcttgatcatcagaaaaccctatggtagttttccccaatcgctttgcgataatcttatctaggttgacgaaggctccgcctacgataaataagatattttccgtattgactcggatatactcttggttaggatgcttacgtcctcctttaggaggaacgtttgctgtggttccttcaacgatttttaacaatgcttgttgaaccccttcgccagaaacatctctagtaatggagacgtttgctgttgtccttccaattttatcgatttcatcgatatagataatgcctcgttctgcacgggcgacatcgtaatcagcagcttgtaataaacgtaagacaatgttctctacatcttcaccgacataacctgcttccgttagggtcgttgcgtcggctatggtgaagggaacatctaaaatttttgccaatgtttttgcaattaatgtttttccagatcctgtagggcctaggagaagcacgttagatttcccgtagcttacctgtttgttatgtagtagagcacgtatacgtttatagtgattataaacagcaacagcgattgtctttttagctctttcctgaccaatgacatattcatcaatatgctttttgatttccttaggggtaagcaccctgagatcagaaggctgtgaaggtgtttcagaaactggagctgaggatattgtagaggagggtttcttatctaaaattccagagcataatttgatgcagtagtcacaaatgtataccgaaggcccagcaatcagtttctctacatctttttcagaccgaccgcaaaatgaacaaatagttagattttttttattcatatgttctctctaagtgctacttgtatccttattagtttctttcgcagaagttaccaccttatcaataagtccgtaggagatggcttcctcggctcccatgaagaaatctcgttcagaatcttctataattttttctacaggttgtcctgtgcattcagagaggatattggcaaggtgtttttttagtgttagaatttcagctgcttggagttggatgtctgcggatgttccgataatgcctccagaaggttggtggatcatcatacggctatggggaagagcgtgacgctttcctttagttcctgcggataataagagggctcccatggatgcagcttgaccgatgcagtaggtatttacatcacaacctaaaaagcgaatggtatcatagattgccagtccagcggtgatgtagccgcctggggaattgatgaaaatttgaatatcctttttaggatcttcggacatgaggaaaaggagctgggcaattactgtgtttgcgaggggctccgtgatttcctgaccgatcattacaatacgatctttcagaagacgggagtaaatatccatggccctttcaccacggcccgtatcctcgacaacatagggtaccagtgtcatttgcgtttcctcatcaaataattttcagttgtgtccatacgttcccgatcacgaaatgaccctaggaacgtagctaagactttttaggctgtctacgtcagcaacaagcttagacattaaaatctcgaattctatgtttaagactttcttgggtcaagtattttcctctaactaaaatttatgcagaaggagttgaagccaacagttctgctttgcgaagaacatgttcgatagctttgctataggtcagccgatcgcgggctgacattacaagttcttgtaaggtgtcattggaaatatctttaggaggttgttgtccgaagcgctctcttgaacatacatccatcatgtattgcagttcttcgcggctaatggtgagtttttcatcagagaaaattttatgagtcaaaaacagtaactttaatgcttttgtagcatcttcttctgcttccttgataagttctgattttcttttttcaagttcttcatcagaacaatattggataagacgtgcattaagaagtttttctcttgtgattaaggaaatacgttcttcaagcagggaggtaggaagttcaaaatctacgagcatggcaagagcatcttcagcttcagaaaagcgtttttgcaattgtttatctttagcttgcttctctagttgtatgcgtaatttcgcttttaaatcgtctagagattctgcttgtagttgacgagctttttcgtcatctatctcggggatcgagacttcgattacagcgtttactgtaaatgttaaagtatctcctcttaagaaggattgaatttcaggggaggtaattgtctcaacaacacgatgtccagtagaaattcctaagaatttttctttaaaggcatcggtcatttcttcttcagaaagcttaaaatatttgttttcaaaaatcgctgcagaggaagcattctcatcattacttttagagacgtgcaaggaaatagaaatgaaatcgccttcttgggaaggacgttctacaggagtttttgttgcaaagaacataccaatgtttgtgagtcccttctcgatatcactatctgaaatctcactagcagcttcttcctgaggtaaagaaaggttttcccaaggaagatcagaaattgcagggaaagcttcataagagaactctactttggctccttcttgaagatcgaattgagtgattgagttcgaacggacagctttaggcgaaagaggacgacgatctccgactgtagataaggcatgataagcgtcttgagttactagttctcctaactcttttcttacgttagtaggatatcgggatgcaattacatcatcaggggcttttcctttgcggaatcctggaagtgtaatttcttttttaatctttttaagagcttgcttgttgagtttgttaagtacttctggggagacttttactaaagctgagacaatacaaccaggagattcttctaaatcgacggagaactgctcattggagagactacgtggcacaagacaaccctttttattagacttgaaaggaaaagcgggtgatgaggcttgaactcacgaccttcacgttggcaacgtgacgctctaccactgagctacacccgcaaagaaaagaatagtttagatttttgaagagtttttagcaacgactagagtctttagtatcatagaaattcgtgtctcttccccctgagaagggctttgataaaatttttcattgatttagcatgggtaaacaggtacaagtaagcagattatattatccactcttattccagaggagaaatgcttaattttcgcaagttacgccgggatttttcagccaatattttacaagatggtaaaaaactttttgagcagggggctgtgattgatgcgaaaatcctttcgatgaatggagagactgtctgcatcagcgctcaggttcggggcttgtacgacaacatttatgagtgtgagattgaagttgatcgctcggaatccgatactgtggattccaactgtgattgttcgtataactacgactgccagcacatcgtcgcactattattctatttagagcaatattttaatgagatggtagtagcctatgctcgtagtgctgatttagaaacggatcacgagatcaacgaggaagtaaaaaaggagctcaaggaaacttttgtcgctgctgccacaaaggaagaagagcgtaaagatcgtgagcatcaaaaagagattttaagagagtatgttcacgctgcaaatgctttaagtgcgaatccttttttcctacctttagaatatttagaaaaggattctgctgagcttgctgtattatttgtttctgtaaatgaggatacgtttgctcctgccaatcagcctatagagtttcaattagtacttcgtttaccgtgtcgttccaagcctttttatatctctaatatccgtacctttttggaaggggtgttgtatcaggagccaattgtattgaatgggcgtcggtttttctttacgatgcaatcgtttaatgcttccgatcgcaagctaatagatttattgattcgctatgtccgttaccccaatcatacaaccgaagagaagttattaaaatctgcgtatttgatgcctcctgcgttaggtgtgattcttgcaaagatgtttgaacatcaactggcagatcgtggaggaggaagtttaggggaaaaagagagtttttcagggttattctgtggaaatcttgaagagcctctgtgttggtcattaactccggctaagatgaagtttaacttagacttctttgacatgccctacaaagcgttgttaatgactcctgtgattcttgttgatgatgatgaagttcagcctgagcagaccatgttattagagtcggatgctccagggattattcatcattttgtttatcatcggttttctcctcagatcaagcgtgcgcatttacgttcctttagtcgtttgcgagatatagcaattccagaggctttgtttggttcgttccgtgagaatgctcttcctgtatttcaggaatatgctgaaattgcgaatgttcaccttttgaattcctttgtgacacttccttatgtagatgaggtccgggccatttgtgatatgagctatttggacggggaattagaggcaaaattacatttcctttatggttctttacgggttccagcagcatctttggctttgcaatatcaggatgttcgtgcctttattagtgatgagggaatcttagccagaaatctggttgaagagcgtaagatgttggaagaggtcttctcaggctttatttatgatgaacgcgatggagcttttcgtgttaaaagtgagaagaagatcgtggaatttatgacggagacgatccctgcgaatcaacatcgcattacttttaactgtccggaaaatctttcaggtcagtttatttatgatgagacgatctttgaattatcgttccgagaagggagcgacattaattattatgaggcagaccttaaggttcatggtttattgaaaggagtgcctttagatttattgtgggactgcattagtgcgaaaaagcgctttttagagcttcctaaagcgggtcagcaatctaagggaacgcggcgcggtaaggtgaattcgggtaagttgccttgtattttagtcttagacttagaaaaaattgctcctgtggtgcagatttttaatgaaataggatttaaagttttagatgacttagttcagaagtgtcctttatggagtttaacgggaatttcgttagatcagtttgaagcacttcctgtgaacttttccatgtctgaaaggcttatagagattcagaagcaaattcgtggtgagatcgagtttgatttccaagatgttcctcagcagattcaggcaacgttacgtagctatcaaaccgagggcgtacattggttagagcgtttgagaaaaatgcatctcaacgggattttagctgatgatatgggacttggaaagactctccaggcgattattgctgttactcagagtaaactagagaaaggcagcggctgttctttgattgtttgtcctacctctttagtttataactggaaggaagagttccgtaaatttaatcctgaattcaggactttagttattgatggagttccttctcaaagacggaagcagttaacggctttagctgatcgcgacgtcgcgattacttcgtataatttattacagaaagacgtggagttatataagagctttcgttttgactatgttgttttagatgaagcgcaccacattaagaatcgtacgactcggaatgcaaaatcggtgaagatgattcaatcggatcatcggttgatattaactggaacgccgatagagaactcgttagaagagttatggagtctttttgatttcttaatgcctggtttattgagcagctacgatcgctttgttggaaagtacatacgtacgggcaactatatgggcaataaagctgacaatatggttgcgcttaagaaaaaggtctcaccttttattcttcgtcgtatgaaagaagatgtattgaaagatcttcctccggtctctgagattttatatcactgtcatcttacagaatctcagaaggagctgtatcagtcctatgcagcttctgcgaagcaagagctttcacgtttggtcaagcaggaaggttttgagcgtatccatattcatgttttagcaactttgactcggttaaagcaaatttgctgtcatcctgctatttttgctaaggatgctccagagcctggggattcagcaaagtatgatatgttgatggatctactttcttctcttgtggattctgggcataagactgtggtctttagtcagtatacaaagatgctgggcattattaagaaagatttagagtctcgaggcattccttttgtctatctagatggttccaccaagaacagactagatttagtgaatcagtttaatgaagatcctagcttgttggttttcttaatttccttaaaagctgggggcacgggcttgaatcttgtcggtgctgatacagtgattcactacgacatgtggtggaatcctgctgtagagaatcaagcgactgaccgagtccatcgtattgggcagagccgttctgtctcttcctataaattggtaaccttgaacacgattgaagaaaaaatccttactttgcagaacaggaaaaagagccttgtaaagaaagtgattaactctgatgatgaggttgtatccaagttaacttgggaagaagtattggaattgctgcagatatgattttatgagtccacatcgcaatctgtttaaacttaagaatttttccaatcgcctttacaacagggctttgggtcgtttcgacaaggtctttaattttttttctggtaatgttggcattgatttaggcactgcaaacactttggtttatgtccgaggtcggggtattgttcttagtgaaccttctgtagttgctgtggatgcacagacgcatgcagtgcttgctgtagggcataaggcgaaagcgatgttgggtaagacgcccagaaagattatggcagtgcgtcctatgaaggatggggtaattgctgattttgagattgctgagggcatgttaaaggctttaattaaacgtgtaactccttctcgtagtgtttttcgcccaagaattttaattgctgttccttctgggattactggagtagaaaaacgtgctgttgaagattctgcattacatgctggggctcaggaagtaatcttaattgaagaacctatggctgctgcgataggtgtggatctgcctgttcatgagcctgcagcgagtatgattattgatattggaggaggcactaccgagattgctattatttctttgggaggaattgttgaatctcgttctttgcgtattgctggggacgaatttgatgagtgtatcattaactacatgcgtcgtacgtacaatttaatgataggtcctcgtactgctgaagaaatcaagattaccattggctcggcctatcctttaggggatcaggagttggagatggaagttcgaggtcgtgatcaggtggcgggcttgccgattaccaagcgtattaattctgtggagattagagagtgtttggctgaacctattcagcagatcatagaatgtgtacgtttgacattagagaagtgtccaccagaactttctgctgatttagtagaacgtggtatggttttagctggagggggcgctttaattaagggattagataaggctttgagtaagaacacaggactttctgtgattacagcaccgcatcctttgctggcagtttgtttaggaaccgggaaagctttggaacatttagatcagtttaagaagcgtaaagggaatttggtatagtcatggtatggagcaccaacatcaagcatgaaggtctgaaatcttggattgatgaggttgctaaattaacgactccgaaggacatacgtctttgtgatggttcggataccgagtatgatgagctctgcactcttatggagagtacagggacgatgatccgtttgaatcctgagtttcatcccaattgctttttggtccgttcgtctgctgatgatgtcgctcgggtagagcaatttactttcatttgcacttcgacggaagcagaggcaggccctacgaataattggagagatcctcaagagatgcgtagggagttgcatcaactttttcgtggatgtatgcaggggcgcactctgtatatagttcctttctgtatgggtcctttagactctccattttctattgtaggtgttgagttaacagattctccttatgtcgtttgttctatgaagatcatgactcgtatgggtgatgatgttttacgttctttagggacttcggggaagtttttaaagtgtttacatagtgtgggtaagcctttatctccaggagaggccgatgtttcttggccttgcaatccgaaatcaatgcggattgtacattttcaagatgatagtagtgtgatgtcttttggaagtggttatggaggcaatgctttactgggtaagaagtgtgtggctcttcgcttagcttcttacatggcaaaatctcagggctggcttgctgagcacatgttgattattggaattaccaatcctgaagggaagaaaaaatacttttctgcttcgttcccgagtgcctgtggtaagacaaatttagctatgttgatgcctaaacttccaggttggaagattgagtgtattggggatgatattgcttggatccgtccgggtcgtgacggcaggttgtatgctgtaaatccagaatatggattttttggtgttgctcctgggacttctgagcgtacaaatcccaatgctttggcaacttgcaggtcgaattctatttttacgaatgttgccttgactgccgatggggatgtttggtgggagggattaacggagcaaccaccagagcctttaacagattggcttggaaagccttggaagcctggagggagtcctgctgcccatccgaattctcgatttacagctcctttacgtcagtgtccttctttagatcctgagtggaatagtcctcagggtgttcccttagatgctattatttttggcggacgtcgttccgaaaccattcctttagtttacgaagctttaagttgggaacacggagtgactataggagcggggatgtcatcgacgacaactgcagctattgttggtcagttaggtaaactccgccacgatccttttgccatgcttcctttctgtgggtataacatggcatattacttccagcattggctttcctttgctgagaatagaagtcttaagcttcctaagatttttggagtcaattggttccgtaagaataatcaaggggagtttctctggcctggttttagtgaaaacttacgtgttctagaatggatattccaaaggactgatggtctggaagatattgcagagcgcacgcctattggttatcttcctaacattcaaaaattcaacctcaatggcttgaatcttgacctacaaactgtacaagaactgttctctgtagatgctgagggttggcttgctgaagttgagaacattggggagtatttgaagatctttggttcggattgtccgcagcagattactgatgagttgttgcgaattaaatcagaattaaaagaaaaataaaaatcaaagtcattagttatttataagttagttttaataacaattatttcttattttttataaattattttttaaataaaattaagaataattgattattattatctgataaataccgtgacgctacaaccgagctacattaatttcacccccaatgtgaccactgctttatctggtggtaagattgatacgtcagctatcgaactttcttgcagcgctctatttttccaagagttgcaagataaagctcagggtttaaaacatgctttgggtttagttcaggagttaagtgcagaggcacttcgtcccgcccaagttcaaacctcaatttcctatcttcctacagaagaatcctcacgtccagggatttctgctggaatcatagataggacaatgccgacctttactgatgacgaggtaaaggctatcctccaaaaccctaattttgaaacgtctaaaattttcgttgagggcttggataaggtcttcaagagttatttagattctgttacccctcccgagggtatagatccttcgaatcctgagagtgctattatacttaactatataacgctcttgaataatcttaagcctaaatttgctgctggttcgacaccaacagacgctgattataacgctctctatgcgttgcctggtgattttgtgaaggaaatcgaggctttgaaagcagcggatgctcctcctaaaagtaaggttcatgctttttggcaggagatcatgacaatttacaataacatgcaggtactttcctatcctgttacggattaccttaatgttcagattgcggatctttctcttaatattaccgctgctcaggaggtccaacagtatctaaagaacttttatagcatattaaaggacattttgaatccaggatggacggatccacaggcgacgcactatccagcagatgcagagtataatgctcgcgatgctggggtgattcaaagtttattaaatttgagtgggaactatcgtcagctgactgagaatatgctccccaatacagatacaagtcttccccaggaaattattgctcagattcgtagtttccaaaatggtgtgaatgggacgataattgcatccaacactcttctacctactaccatgagactcgatactctccttggtgttatctatacctatcagtgttgtgccactatttttggaatgagctatggaactagcactccggctaagcaaaattacatagatgctattaatcaagaaaaaagttactggcaagcgcgagcaaatggatttgatgtaactagtgatcaggtttttgaccaatttgctactaatatacagagcggcacttcatatagaggcatagatcttttcaaaaataataaagtaaacgagatcaatcctattttcttaagtcaggctgcatctttcttacggtatccgtataatttgatgtcacgtagtatgtatcaaactatagaggatgctgctaatagatctattacggctttggatgggctaatttccggttggagtacacagatagcaaccttccaaacgcagaaaaattctttggatccttctttgttgaagtattttgatactatgaaagccaacaaagagtcttttgtaaccacagctcctttgcagatggtctactcttcattgatgttggataagtatttgcctacgcagcagaacgtgattgcctccttagggatacagatgacgtattctaataaggctgctaagtatctcaacgaactaatcaaagagatcactacgtttcaatctgccgatatttattattctttatctatatatttgaaacagatgaatttgcaagcggtagcggatcctattggtaaggctgtgggtgttttgaatgatgaaaaaacacgagcgatggcagatattacccgctgcaataagataaaagcggctattgataagatgctcgttgagatcaaggcggatgcagagttatcaaagtcacaaattcgtgagcttgtggatacgttaacaaacttcaagtctcaaagcgacgatctgattcgcaatttatcttgtttactgggtttcttatcagggctcacccttaaagctgtgaatgaccctaatgctacgtatgaggcatttactgcagaaatcttcacagaaccttttaataattggaaacggcagttagctacatttgagagttttgtgattcaaggtgggcaaaatggaattaccccaggtggtcagcaacagctcttacaggctatggagtcttcacaacaagatttttcaacgtttaaccagaaccaacagcttgctctgcaattagaatcatcagcaatgcaacaggaatggactcttgtaagtgctgcccttgctttattaaaccaaatggtttcgaagattgcgagaaggattaaatcttagtacttaggaaatagaatattatgcatccgaaaatagaaaaaagaaatagccttccacttacggcagtcgctcctgtgtttgaagaatcgtatcatccttctgtagctacaactgtagattatgtagatgccacgacactttcccgacatcttacagtcttaaaagatgtgataaaagaagctcgaaacttagatttagggaaggcattcctgacatctatgaaacagggttttataaatacgggtacggaacttgccattatacaagcatctctggcagatcagagtagtcgcgagtcgcgtaagaaggaagagaagatcttccatcagcacttaggaaaggcagccccacaagcggcaacagcaacttcaggagtgcagcctactgcggatcctgttgctgataagatgcctttacaatctgcatttgcctatgttctccttgataagtacattcctgctcaagaggaagccctttatgctcttggaagggagttaaacctatcaggatatgcgcaaaatttatttagtcctcttttagatatgattaagagctttaactctgctcctatcaactacaatttaggatcgtacatatctcagacgagtggcactgcgaatttcgcgtatggttatgagatgattttatcgcgctataacaacgaagtctctcaatgtcgcctggacatagcaagtacagtaaaagctaaagctgcgttagcgaacatgtcggcttctgttaaagcaaatgtgagtctgactgatgcacagaagaaacaaattgaggatatcattgccagctatacgaaatctttagatgtgattcatacacagttaactgatgtgatgacaaatttagcatccataacctttgttcctggtttaaataaatatgatccttcgtatcgcattgttggtggggatttatctatcattgccttgcagaatgacgagaaggtacttgtcgatggtaaggtggatatcacgactgctgtgaatgaaggaggcctacttaatttcttcactacagtccttacggatgtgcagaattatggagacttagctcaaacgcaacagctgatgttggacttagagcttaaggcgatgcaacaacaatggagtttagtatctgcatctttgaaattattgaatgggatgtataccacagtaatttctggatttaaaaactaaaactgcagacctgacgtaatgttgatagcacgctgatatccccaacggccttctacactatagtagaagttatttgagatgcagcaggtagttccgaagcagaagtttactctgtcgaagtttgtgattttacgaattttaaatttaaaattcgtaaattgcttttcgagttctgtgaagctatcagaaggagcttttcttgaagtatttcctatagatacggatgcatagggaagcacatagtcattaagatacgtagagatgccgatgcttgcagaccattctttatagcttaggtttccatcagtagcatcgaaatagatctcggggttggccttgttgtaaacgatgatatagttgatgggactggaaccgtgacggtagtcagcgctcacccctacaaaagacactccatctttccacaatactttttgtaaactcagaccccagacaattccatagtctgactggacttcaatgagaccatctgtaacttcagattctgcatttaaaggatttgaagtgaagtctctgtaagcattgagagggaggcggtagtactgcttaagtcctccgacacgtgcagtgaaggctatatctaaaaggggaatggcagctggggatgtttcctgtagagctatggttgcaaaaacacagctcgagctgatggagctgttgttaagatcaaagtctacgtttttagttgtagaggtaatggttggcgttgttcctgtgcctgaagtcgtaacggaggtaatgacagggacattggtaatatgggcactttctgagaagacataatctccatagaacccaaatttgaggcttcctgcaagagcagcaaaaagatcgtaactattacaaagttggaaggcacaccatcccgtttgctcaggattcacacctgggagtactggagctgcagggtttccagcccctagggcatatactgcgggagaagatacaatcccgaagaacatagagaaggaaagggttgctaaacgtaaatgttttagcatcttgctattcatgtcaaaggggccttatttgcttttaatgattaagtcctctttaccagatggtataaaaaatgtacaaatgaaaagacaagtgacgggtaggatcttagaatgttgtaggtctcgggtctttttttcacctggattctttaattttctgaaagattataggaactcttcttttgtatttctctgtaagaggagagcaatgccctctttgagatcaagattttcatagagaacgcgatagattcccgtagtgatgggcatatcgattttatgatgtttggcgacttggtatgcagaaagtgctgtgtaggctccttcgactaccatcccaatttttgcttttgcttgttcgaaagtaagaccttgagcaagaaggtgcccgaaccgtaaattccgactcgactctgagaagcaggtaacacaaagatctccaagacctgcaaggccatttagagtttctggtttacaatccatgatagcggcgagtttacgcatttcatgcaatccccgggtcacaaggcctgcttttgcattgtttccaaacgataatccctcagcaatcccacaggcaatagcaatcacatttttcaaagctcctccgagagcagcacctttaatatcggtattagggtagactcggaaggtggggagggaaaaagcttcgtggatttgtttgagagtttgtgaatcgtaagcgctgactacgacagaacagggagaaccgtttaggacctctttagcgatggaaggaccactgagataccctaaatatggagtcacggaatctccaagcacttcgagcatgatttcactgaggaggagtcctgtattttgctcgattcccttagaggtaattacaaaggggaccgagaggtcagtgatttgttttaattgctctgctacgggacggattcctgcggaggtcactccttctacaatcatgaaagcattgtggatcgcttctttcatgtctgtagtgaatgaaaggtttggagagatgacaacattgggagctaaaggatgacgtcgttcttcttgtaattgcttgattaggtcagggttccgggaccatgccacaacaggatatcccttattcgcaagtagggaggctagacaaaacccccaaattcccatacctaagtagccgatgtgttgtttcatgaggcctcaaaaaatggttcctcgaaaaatgctttgttttcccaatgtagggaagttgatgttgaaggataataaaaatcagcttctaattcaaatgttgtgttaggagagagcttttttcctgtgactttgtggaagagttggcgctctcggtcagagagagcttgtcttactgtatcggggctatgattgccctccagattttttaggggagcaaagcactcttgtctaggatacacaagagtttgacaatggtcgctataacaaaatagatcaaagataaactcttcaaatttccaagcatttttctcatttaaggaggtatggcctagttgcttggcatgcttgtggactttatacaggggcagctgttggtaggcggcgtggcggataaagtccatggagagacagtaaagaccgatatttgcaaggcagtattttaattttccatcttcattaagagcgaatctctcgttttggggaatttcagagtattcgataacagaagtttttccagaatcatgagattttacaagaatacccacatcttcaatagcagtttgacgtagagccgcttttatggttacctcgttgttagacatcgcatggaatccacagagttctacgtcaaaaggaagcgctaaaggattgtcaatggggatcacacttaccatttctatgccagcatttttccatttctcccatactcctgaagtatagagaagggtagctatacaaccgttgccattcggaccaagagctagagtgtccatatcttcaagaaataggtctccagatagggtgaggaggggccaaagtggttggcagaaaaaatccacctgatttggatctaggtggaagtagtcgttggattcaaaaaaagaacgtgtttgtcgggtattcaaaggagaggtcatgaatgctagaggaagaggttgacctgcaagtttacttgcagcacgtaccttttctgctaccaactgaaacagcggcttctttttaataggagaaacagggaataaccctttagggccatcgcacttcaatcttgagccttgtccccctgccaggactacacaggcaacttttttctctttaagtagcgtagttcctgcatgagctcgttctggatcttctcctgaagaggcaaatgacgttatcggatgaaaatctttaagaattgctgttggtgaggaaagcagttgctgttgcttacgaaaaaaatcaatatctacagaggtgagctgctgaaaaagtctttgttgttgttttggagaaagggagggccagatatctaatatatgttcttgatttatggctttgagcttatctgctagagagtttacatgcatagcagagggcgaatataccgattcagtcattacagttagccttacgttcctatctcttgatccttagaatacttattgttcttgatcttttcgatgatttttctgcggtttattaattcctggagttgttggtgatggatttcaagaaagcgaagagattcgctctgttgtttataaagagatgattgtaatgtttttaagtattctaggagtatatcataatgttttatgttatctcgagaaataaaatgctcataacgttccaggtgtaaatcagcaatccttttatttgtagcttgaatatttcgtgatactgttaaagctaagcgcttctgattatgaagggtatctaaatatttatggatttttacttttaagattaaagataggctcccaagtcgatctctcatgagtctgctaatgcctcgagctgttttaatgtattgtctaagtaacagtaactagacaagggttgcgctaggaaggctttgatgctgggaaggagcttcactgctttatctaactcttcatcttgaccgggagtgtaagctcctagatgaatgatatctaaagcttcattatataccttaagtagtgaacgaagtctttctgcagctgcataatgatggggaagtgctagtgcttgtgctgaccgagaaagacttgataaaatatcgattgggggggaggctaaggctttaccttggcttgttaggaaaaagtgtccatccaacagcgattttaaatagtctgtaaaaatatcaggatgcttcgggtaatataaaatcgcatacagagctgttatggaccccttgtcattgtttccggcacgttctgtaaattcagatacatggtgaaagacagaggcggcatattggtgcgcagagagtgtttctcctcgcgctaaagcgacttcttggagtgcagcgatccatcgggataaagagtccataataaataagacttcatggccttgctctcgaaaatattctgctattgtcatagccgctcgccctgcgattacttttgttggtgcagtctcatgggcaggtgctgcaatgatgatcgtacgctgctgtttcagggcattgctatgcttctctatgtattctcggacttcgcgtccccgctctccaattaaagcaatcacattgattgtagattttgatcctaaagcgattgctgagagcagtgaagacttcccacttcctggctcagagaaaactccaatacgctgtcctttccctaaggtaagaaatgcatcgattgctttaatccctgtagggaagatctgatcgataggttgtctcatcataggggatggcggtagagacagaagaggttttcgatgtgttttaggaaggtcctctttcttgtcaatagggttgccgaaagcatctaagactctccctaaaagatgatctgagagatgtagagagggggggcggcgtaaaggaaggacttctgttccaagagctacagagtgtaacggagatagggacatgagaagtgtcgtgtgattgtgaaagccaatcacttcagcaagaagattcggatctttggttgaggaaattttgcagagctcccccaggcatgcagagagcccatcgacctcaataagatttccagagaccttagataatagaccacaggcacggtagggctgccagttatgaatatgaagtttttctttatttagatgattcatgctgtcaaaacagaaagtagatggtctagttcttcgctgatttcttgtctcagaattccgttaggggtttctattttgaatcctgatcgtctacaagaagtgtcagggaaaaactcagcatgcttaatcatggggagttcgtgggtggagatccaatctgtaagtgttttgagatcctcgggatggagaaatactttgatgggagtcagagatcttaatgtcgtatgtctttggagcgcggtagagaggagcagggccagttcttgaggattttctagcttcttatagagaaatttttcacagatgagaagagccagttctagtaggtcgggttttagctgttgtactgttttttcgacttcactaagtaggtgaatggatagcttgcgaaagagatgaactaacgaatggagttcttggcttgccttatcattcggatcttcgggaagacttgtaggttctgtatcccaaggatcatgtggatgaggaaggtgagattgagaaagcgaaccaggagattgtggtgttgtcacaagaaatacctaattcttaaagtttatatttcagcacttgatgtttgagatcttcgggtaatctgtttaataaggcttctgctttcttagggtccaggtacgaaagaattaaagctattttttctggagattccttttgtataatctctaacagctttgagatatttatgcctcgttttattttcctaggttcgggggagactctctcataagcgtgtcttgcgaggtagaaactagctaaagcaacaatcatcaagcttatgacaagaatcatactcccgattagaacttttgctgggaacgattttttattctgtaaacgagcgaaagggagggtttctatgacaatatcataggagtcgtcatagttttgatagaggtagtgtttagtatgggctacaatcttttcggattcttctttggttaaatgagcaatataattttcatttaaagtgagctgtaatgtgggcttctctgcttttgcgtgatacgcaagagcaaagtgttccttggggaaaattttccccaggtaattttctaatgtatggatgaacagagaatttacagttatagattcaggaatatagaggttccctaagttgtcagatagggatatatgttctcgtttcaacccaggaagactgctgcatagatagtctgtaattgagaagagtagtgaaggagttagggactcttcttttcttaaagtaagaatgacagagagatgcagaggagacatgacgtcatcttctgtagacagagcaatggcaacttttgcagatgcaatgggatggaaggaggtcagatctttttctaactgctctttttttgttagagattctatgagcttggggttccccatttgtgtgagcttcagccaattgccagaagttttttctgttttaacttgagtaggggctaaggatgggttcgaggatcttccaaataaaatagcacaactcaccaccccacctattaataggcatcctaggggagaaatccccaaagcggtaagtttttttgccaaattttgaaaaaacacaagagtccttcataaaaataaacgaaacctatggcattgttgccatcgtattcttctctatcaaaaagtaggaattattgacaattgcatctcctcttaggatttaggacttggaaaattttgaatgaaaattttagagcctacattccaaagaatggttagagaaggattttaagttgctagaggttgaatttgttggaatcaagaacacgtgaaatgaaagcctctacaatgatagagactcgtatttaggaatgtagggatttctactaaaagaagttggggggatggctacgggtgagaaagatttaatgatgattcatctaccttcacttgaagttcagggtagatataggctcttaggagctgccctatggaatttaaagtagatcctaatgacgaaggacatccagaacaattcccagaataggcaattgtgacaataaagttttctagggattctacagttacttcacctccgtccatagcaatgtaagggccgattttttctgctattgtagcgcgaagagcatagagcttttgttcgtgagtgagagcttcccaatcactctggctatagggattcgcgtcttcgaaatcaaggttcatgggagaattttgcaaaggaagcgagccatcctctaaggggatttcaagacattgctcaacagctgtatctaaggcatcaataacaaaatggtatagcgagatgctatcttcaggaagagcgggttggtgtgcgtgtacgcgtaaggatttatcaatatcatcaagagtcatcttgtaagcttcgctatagcttttcccacaaacaagattgcagacagcctccgctagtgggattagataagggtgaccaaagtattggaattttgcatccaggattacgccatttttcttatccacaagccaataaaaagtgacgcagttgcccatcagtctgtgcccctgttttccagtgaccagatgtgcttctttagcttcagcatcctcttcagaaaacgtgcccgcacaatgtggtgtaaggaattttttcataacttttgctgatagcgaggaccaaaaaatcattggttctagaggtagggtcatgaggaacttccaagtaaaggggtaagatgcttaatggcatcatgcatggcacgagcaagtttggaaaactcgaggtctttacttctttctgtaagagagaaatgtaaggcactgtgacataagaacggggagatcccacaattttgtaacacttgagctaggggctggaatctctcgtatcctaaggatggatagatgccttgctggtggagatggaaggcaagactctctgctgggatgtcaggaattgcagcaacaacgatattaggtaatcggttctggacctcggaaaatgccaattggattgaggggaggacgctttgtaactcttgaattagctttttacacaaattggaggtgtggaatgtgaaaagcggaagagcggaaatacgttcttcacacgcagtttgcattgctgccaccgcactgaaacataaagatgctgaagtgtgaggtggaaaccaggaagaaaagaccctctctaaagatttacgaatgaagatccccccgatagagcccatacctccaagagctgctgaagagaaagtaatgatgtcagcgttgaggatctcaggagttagaggagctcttcctaaaatgtcagaaatatccaagtgaaggaggattctgcggtctttgcataaggagagcagaggatctaagggttggattacccctgtcaatccatgagctgcagatagtgagaataacaaactacgtggactcaaggtttctataagctgttcttcaacaatcctaccttcgtgatttactgttacccagtcataggtagttccgagtccttgatggcgacataggctattaattaaaagctgttgatcatgagcaggaagaatgatgtgatttcttccttgaaacatggacagattttctacaagggctgccaggactatatgaaccacatgagggaaatgagggacaaaacgaaaaatatgagagtctttcaatccgaccaactgtcggatactctcctctgttttctcagctaattttaacgcggagccggggggtagagaaaatatgtccgagtgtagggcataactttctttaacccgctcagaaggaggaatagcgacttggttgtttaaccaaaaaattctgggtgcttttcgattttgtggtttttccattgatatacaactggttttcccgtcggtaattctaaagatagtacctcttcctcacttaatttttctagatccataatcaaagagcgtaaggaatttccgtgcgcagaaacaaaaacgttttttccattttgcagttgaggcaaaatatttttttcaaagtaaggcaaggtcctttgtttcgtatcatagaggctttctccctgaggaggagctgttttgtagctgcgcctccacagcttgacccgctcttctccgaactgttcggctgtttgttttttattttttccttgaagttcgccgtacattctttcgttgagggcactagattgatagagaggaatcatattgttttcttcttccgcactgtagatcctcgacatctcttttgctttgggatcttcatgaacaatataggggatcttcttagagtgatgatttgtcatggcgagtaaggcggtcatcagactacgtactaaggtagaggtaaagatgcagtctataggcaaattttgaatagctcttcctgcggaaaaagcctcttcaattccctgttggcttaaaggaatgtctacccatccagaaaataaatttttttcattccatacagattgtccatgacgtaataaaataagaagagccatatgttcctactagaatttagggtgagaagctaagcataagcagaaatcaacttttgtctagtagaaaatatagaagtaaaaaaagtttttaagcaaagaaaagtagaccagtattgccttgcttaggcacaataggtgcttgatatggggtaaacgtgacaaaagttcgtcttaataaatttttagcttctgcgggagttgcttctcgaaggaagtgtgatgaaattattttttctggatccgtgactgtgaatggtcgtgttgctgagggtccctttgttcttgtagatccagaagataaagtacaggtgggaggaacctctgttcatctcactaagaaagtatatttcatggtgcataaagctatcgggtatctgtgttcttctgagaagaagtttcctggaactaagttggtgatcgatcttttcgcacatcttccctaccgtgtgtttactgtgggacgtttggataaagagacctccggattaatcttagtgactaatgatggggaatttgcaaataaaatcattcacccctcctcaggaattaccaaagagtatcttctaaaagttagccgcgatgtctctgcaaaagatttgggaaaattaatggaggggactttcatagacggcaaacatgtgcgtcctgtctctgtgactaaaattcgtcgtggtacagtaaagatcgtcgtgagtgaagggaaaaaacacgagatccggttgtttgcagatgctgcaggatttcctattttagagctaaagcgtatccgtatagggagtttggttttaggaggcttgcgttatggcgaatatcgcgagcttacagatgcggaactcgggacctacatgaaattgtctgactaacttgtttttttatatactaacctgcaatagatagagccctatgggatatgttttctatgtgatcgctggcagtatatttcttggcatcagtttgggtgcctattgtcaactctactattcagtaaaaagcgtactattttcttggtacttgttaacagtatatgctttggaaaagcgtcatgcgttgctcgctctctctcaacttgtaggcgaagaagacgcccagtcccaaaaggaaatcgactttctctcgcagtgtgacaagctctcttggcgtgcgttcctcaaaaatagctacgagatcatcccaacatttaaagagatggaagaccttctttctgaaagagtgcagggattcctagagtctatagaaacgattgcagagcacgatcgagcgatcttgtgtatcgaaaacttttgggcaagtaaaaatctatttgattttgagattgcagcttacgaagaagctgtggagaagtatcttaagttgcgacagcgagcccctttgagacttgcctcaaagttgttccgctttttagatgttccctcgattcgatttagtagctaagctatcgggaagattctcctgcaacactcctaggagatggtgtataagaagctccctggtagtctcaaggtctatgggatggccaagaatctcttgaagggatgttgcaggttgtccgacatcttttaaagcttgtttcgtagtattgccattgaggccgatcccaagaacgactccaagaagtccttctacagggagagtctctggaagaactccacagagcttttctccatgaaccaggacatcgttaggccattttatttttgcttctgtaattcctaaatccttacataaggcaacaacagcttctgtgcctaagcgaaagagacgtgatacatcgatgtggaggtctgtaataaaaaaacagaaggtattaagaagatccccctttgaagatttccagcttttaccaaattttcctgtgcccgcagtttgacattttgtggagattacagttaatgcataaggatcccacaaatgcatataggattttgccattgtgttcgtggagggaatttcttctatttcgtaataaataactttcatattctagaaatttacagtctgctcaatagtaatacgattatgagatatcataaatattttcggtatgtgaattcttgggtttttcttgtcgtacttaccttaatgctattaagtgttgtggtcatttcttcaatggatcctacagcgatgctggtgacctcctccaaaggcctcttgaccaataaaagtatcatgcagctcaggcatttcgctctaggatgggtcgttttttttatctgtgcctacttcgattatcacttatttaaacgatgggcatgggtactctactttttcatgatttgtgctctcgtgggccttttttttgttccgtcagtccaaaatgtccatagatggtaccgtattcctttcatccatatgagcgtacagccctcagaatatggaaagcttgtgatcgtgataatgctcagttatatcttggaatcccgaaaagcagatattacatcgaaaacaacagcattccttgcttgcttagttgtcgcacttccgttctttctaattttaaaagagcctgatttaggaaccgcattagtcttatgtcctgtgacattgacgattttctatttaagtaatgtccattctttactagtaaaattttgtacagtggtcgctaccatcggaattataggctcgttattgattttttcaggaatcgtctcacatcagaaagtgaaaccctatgctctgaaagtcatcaaggaatatcaatacgagcgactcagcccgtcaaatcatcaccaacgcgcgtctctcatttctatagggctgggaggaattcgaggtcgtggatggaaaactggggagtttgcaggtcgtggatggctaccctacggctacacagactctgtattctcggcattaggagaggaattcgggttgctggggctactctttactctagggctattttattgtcttatctgttttggttgtcgaactgttgcagtcgccactgatgactttggaaaactcctcgctgctggcattaccgtatacctagcgatgcacgtcttaatcaatattagcatgatgtgcgggctgctacctatcacaggagtccctctgattctaatttcctatgggggctcttcggtaatctctacaatggcatcccttggtgtattgcaaagtatctatagccatcgctttgctaagtactaacttttcagcaaacggagagcatttaaccccacaatcaccgtacttccctcatgaagaattaccgcgagccatagaggaatgatccctaacgatgcaggccaggagactaaaagaataatagcaagcgctagtgcaaggttctgcgaaacaacttttttcgtttgttttgctttttgaatgatccaagggagggacgacaaggagtcgtgcaggagaacaatatcagcagcttctattgctgtagcgcttccagcttctcccatagcaatgcctacagtagcttgtgctaaagcaggagcatcattaattccatcgccgaccatcataatttgacgttgtgttgcaagctcgcgtattttcgctaacttatcctcaggggtgagatcgaaaaatacctcagaaattcctaaaatttccgctgtattttcagcactgactttatgatctcccgtgagcatgctcacgggatagccgagatctttgagatcttgaatgatttctttagcttgaggacgaggaatatctcgaaaataaaatagagcaaaactattcccaacatacgctagagaacaaatctccccatgttgcttcgcctgataaattttttgttctatatcttcaagatactcagaaggcaccttccctagtcctgtttctacccgacctacaaaagcttcttgttcattgaaatagccacgaaccccctctccaggaactgtaagataccgatctgcaggaagcgaggataccttctgctccataaggtaagaaacaatagcctcagcaatcggatgagatgaagactgctctaaagctaatactgaagggaaaaaggtctcatttttagaaccgaagtagtcgcaacctatacaggtaagctcgccagtcgttaacgttcccgttttatccatcactacagaattacaagaaactaaacgatctaaaatcacaccgcctttcaggagaaccccatgtttcgcacaggcattgatagcacttaaataggcaataggaatcgcaatgatcaaagcacacggagacgctgcaataagaaacgctagggcacggtaaaatgcactctgaggtcctaacaatggaatggaagtaaataaaggaaccaaaagggcaattccacaggcaattgcaaaaatagagagagcatatactgaagaatatttatctaagcgttgctgtaacctaggtttagagttctgtgcctgaatgactaaattgataatatgagcgatggtagaatccgatcccgtacgtaagacacgaagatcgaaactcccttccatattatgggctcccgcaggaacaatcgaccctggatgacaggatttaggaactttttctccagtaagatgcatgaggttgatagaagaagaaccatgaaggatttctccgtccaaaggcacaacctcgccacttttaatgcgtaggatatttccaacctcaatcttgttgattgcgactttttgtaagttgccatcttctaagacaagccaacccgtagtaggagcgagctgcttcaaagagactaaagtgctctttgctttccccgataccatctgtcccaacgcttctgaaatcgcaaacaagacaagaagcaaggctccttctaaagctcctccaataaaaatagagccgaaggctgctgatgtcatcaaaatatcaatgttcactaccttttgacatatgttatctaacgacttaatcagagcaggagtgccagcaagaaaaaatgtaaatactacaaataagttagagagattttttgcatggagccagaaacttagaagagcaatcaagtaggtccctaaagataaatacgccgattttaaaggaagattgtgactcaatttgcgattttgtttagatagaaggggactcgtatcttcagacatccctgattcaaaaaatgtattcactacttctgcagaaaatgaagtgaaaaacaaacgggagaacacgtagcgacctgttataataatttcattaatgatgagataatactcgcggaagtgatgaagatccctaacacccaaaccatttcggaaattttatcgttttttagaattttagcttttaggaaggaaagaaccagaaccataagagcagaaaagacccctgcaagagtgtagctgatgcataggactagtgggaggaaaatggcaagcccacatagacctcctaatattctagatcctccttgaatcaggggatgaggaagatcttcttttcgaatgtaaagctcttctcgaatcatcgtatctagtagtagggtagaatcggaacagacatattctaccatctcttggaggagagggtctttaaacccttgattctcaaacaaaatccggagttctattttttcttgttcaaaattctcttcaatctcgtttttctcttccagcatagaacgatgcgagagttccatataggcccaagcttttcttgcttttaagcatccgtggtaaaatgtccagccaacgcctaaagatattaaggattttacttgaagcgcacgattcgtaggaattaagaaaaacaacgtccgaatgaaaaaaataaaaacgccagtagataaagcattattagctaagtgatagaaaaaccctttaaaggttgtatggggctcccctttacagactctgtgcttgtctctaacatgctttatgtggtcctctggagtgcgtgatttaaagtggtcatgtggatcctgagtcataattttccttagaatttgatgctgtctacagtctgatgtgttctcactggtctttgggaagaagaatctccaaccctcctaaataaggacgaaggacttcaggaataaccacagagccatcagcttgttggttattttctaaaatagctaccaagagacgtggtgttgccagacctgaaccgttaagagtatgaacaaactgtagtttcccttggctatctttatagcgagtcccagagcgccgcgattggaaatccgtacactgagaaatagaagacacttcataaaaagctttttgtcctggcaaccagacctcagcatctatagtcttggatgctgtaaaagacatatcccccgtagaaagcaaagaaagacgataaggcaacttgagctctgtcagcatttcttcaacaatactaagcattttttcataagcaatatcatcttgattgggtgttgtaaaggcaaacatttctaccttatggaattgatgcacccgcacaagtcctctctcttgagctcctgcagcacctgcttctcttcggaagcacggagtgcacgcagcatagtaaagaggaagttctttttctgttaaaatgtcttgggaacgaaacccattaagaacgacttccgcagtggggatcagatagagatactgctctccgtcctcaacacgatagtattgtccatcaaatttcggaatctgcccagagccaaataaaatttctttcttcactaataaggggggaagccagagctgaaatccatgagctgcttgcttctgtaacatatacgtaagaagagcccattccagaagaacaccacgatttttataagcaggccatcctgatcctgtcgtttttgctgctgcttggaaatctaagatgtctaactcctgatttagctctaagtgatgcttcggaggaaaggaaaatataggaaggtccccaacacttttaatgacttgatttcccgctttgtcctcggatacaggaatgtcgtcagcagggtaattaggaagatggctcagcaattcatgtagttgagcgtttttttgatcgaggtgctgctcaattttttcaagatccgcagcaagagtctctacctcttgaattaagtttgtcgcgtctaccccttgcgttttagctttatgtatatcttgagataagaggcgtctttgtgcttgtaaagtttctgaatccgtcttgagttgacggacctctttatccaaggagagtacaggttctaaagaaatttttggatcttttttacgaagtcgagtttcacattcttcgggagtcttgcgtataatttttatatccaacatgcttgtctcattgttaagtagaagtgtgcaaaagtgagagtatatggaagatttctctgagcaacaactcttttttatgcggcgtgctatagaaatcggagaaaagggtagaatcacagcccccccaaatccttgggtagggtgtgtggtcgttcaagaaaatcgcatcataggggagggatttcatgcgtatgctggaggaccccacgctgaagagctcgccatacaaaacgcctctatgcctatatcaggatccgatgtctatgtttctctagagccttgctctcattttgggtcatgccccccatgtgcgaacttactaatcaaacataaggtctctagagtttttgttgctcttgttgatcctgatcccaaagtcgcaggtcaaggaatcgccatgctacgtcaggcagggattcaggtctatgtcggtattggagagagcgaagcacaggcgtctctacagccgtatctataccaaaggacccacaacttcccttggacaatattgaaaagtgccgcaagtgttgatggtcaagttgccgattctcaagggaagtctcaatggattacttgtccagaggctcgtcatgatgtgggaaaattgcgagcagagtcccaagccattcttgtcggttctcgtacggttcttagtgacgatccgtggctcacagcaagacaacctcagggaatgctctatcccaaacagcctctacgtgtcgtcttagacagtcgtgggagcgtccctcctacatcaaaagtctttgataagaccagtccgactctgtatgtaaccacagaacgatgtcctgaaaattatataaaagttttagattccttagacgtccccgttttactcacagaatctaccccatcaggagtggatcttcacaaggtctatgagtatcttgctcaaaaaaagatactacaggttcttgtagaaggaggcaccacactacatacgtctttgctaaaagaaagatttgttaattctttggttctttactctgggcctatgattcttggggaccaaaagagacctctagtcggagtattaggaaatttgttggaatctgcctctcctctaactctgaaaagttcccaaattttaggaaattctttgaaggtcgtatgggagatttcccctcaggttttcgagcccataaggaattgaaaggaaaggatttttagagtagcatgcttagcatcggaatccgttaatgcgagggagtcaatgatagaaactcgagaagaggtaggctctgcaaattttgtttctttagaacgagctattgaggatttaagagcaggaaaatttgttattgttgttgatgaagcttcgagagaagatgaaggcgacctgattatcgcgggagaaaaaattacagttgaaaagatgacgtttcttctccagcacaccacaggagtggtttgcgctgctttaagccaagaacgtctcttaagcttggatcttcctcccatggttaaggataaccgttgccgttttaaaactcccttcactgtatccgtagatgctgctcacggggtgactacaggagtttctgccgcagatagaaccaaagtcgttcagttattagcagatcctaagagcaaacccgaagattttattagcccaggacactttttccccctagcaagttctccaggaggagtgttaaaacgagcaggtcatacagaatctactgttgacctaatggagttggcaggactgcagccttgtggtgtactcgcagaattagtgaacgaagactactctatgatgcgattgcctcaaattttagagttcgcaaggaaacataatattgcagtgattcccgtgacatcgatcattgctcatcgcatgctctccgatcgtttggtttctaaaatctcttcagcacgcctccctacaatttacggagactttacgattcatgtctatgaatccttattggaaggaatgcaacatcttgctttggtaaaaggcaatgttgctggaaaaagtaatgtcctcgtacgtgtccactcagagtgtgtcacaggagatattttaggatctaagcgctgtgattgtggagaacaattgagttcagcaatgtcctacattgctgagaagggaactggtgttcttgtttacttgcgagggcaggaaggccgagggatcggtttgggccataaagtacgtgcttatgctttgcaagataacggttatgatactgtagatgcaaacttagctatgggatttcccgtagactcaagggaatatggcataggagcacaaattcttgttgatctcaagttgacaaccataaaattaatcactcataatcctcaaaaatattttgggcttcaaggtttcggacttagcatcacagaaagagttcctcttcctgttcgcatttctgaagacaatgagcagtatttaagaacaaaacaggaacgtatgggacattggctagatctcccatgctgtaacaatcgggtacaataattttgaggagtatatgaaaacattgaaaggacatttgtctgcaaagaatctacgtattgctattgtcggctcctgctttaatcaagctatggctgatgccctagtttctggtactcaggaaacttttttgaagtttggagggagcgaggacggcttgatgactatccgtgttcccggagcttttgagattccctgtacgatcaaaaaacttttatcttctgaaagaaagttcgatgctattgttgcatgcggcgtcctaattcaaggagaaacagaccattataaccaaattgtaaatcaagtagcggcaggtattggtgctctctctttggaattttgtcttcccataaccttgtccatagttgcagctccttctgcagaaatcgcttggcaaagatcaggtattaaaggacgtcatttgggagtttctgggatgacgacagctatagaaatggcaacgttattcactcaaatctagttcttgtaagaacgtatacgtcccacaaaatttgtgggactcttccttctacagattgatgctgacagctccatttaaatggatgcgaactgcgatactctcagcaaagacatccaagcctcccgaagacaatgtcgtctcagaaaaatctaacacagtcccttgcgggagaagttgtttatttagcatttctctatgagaacgtaagctttttaccaataaggatagcattgtcgagtataattgacgtagacgattttctggacttaccgtagatccatgagtcgcgaccgaaagtcccgcaactaaactgggaagaccacgaaatgttaaaggaatatgctctccttgtactgtatagaaactgttaacaagattctcagcttcatcagaaggtaaatttttaaaactccacgccaaagtactcgcttccgacggagagagattcattaatgttgctaagcgaaccaaagtcatgtccgttcgagaggttccctcaaaacctaaacgattcgctcgataagtaaaataacgagagaatgcctcttctatagtcgcatgctgctgtaacatggaaagtagaggagcaaagtttatatagaactcttgagaacagttcttgtctccacaggtatctaagcaatacaggtacaaatctaagatcgcaagagaccgacgtgttctccaagcagaaagcagctgcgcactaggaacctctgttaagttcagtagagaatcgtagttgcccaaacgtcttagagataacaagacttcttgctgttctggagaaagcctcgcataagaaggacaaagttcagggaaagtacgcaacacatgtaacgcctttgcgtaaaagctctgtgggcacgagtctgtgaaataaggcttaaacgtggtgacagcttttgcagagcagcctacatgtctgagcacgatcgctgtttctaaaattctcaaggtattatcgaaactcttaggagaatttaaaaagaacaataattgtttgtgcgccgtctggaattgcttaaatgtcatacctccttcttcagaagggaggatctgagagagctgcatgtaagattgacgagacccctgtatcaaaagatgtaggtgaatcatactgcgaatcgcaatgtctaaagcggggacttttttattaaagagcttttcagaataggccatatcgataggagtcgatgtgagaagaggagcccctccagattccgtaagccaaagaagctcaggatactgacgtagtttttgttctatccaaacctcagaaccaattttaacctttgtctgcgagttcgtctgtagagatccttgggggccagcatagccgatagaattgcatcccataagtaaagctaatgggaaaaccaagactttgattttaagaatttttaacatggaagcctcttctctatcacgttgctttgttaatatctttaaatttaaagagattaactaaaaaccccattttgataacaaaatgcccaataacaaatcaacttgagaaacgcaaggacgttttcctcggaagaattaaagattccaacataaggatttagttatgttaataacttaataatttatttttgtaataaataggcctttttaaaaggaaaatgtgttataatctttaaaattaaatttttattttaactaaaaataatgaaaagagtcatttataaaaccatattttgcgggttaactttacttacaagtttgagtagttgttccctggatcctaaaggatataacctagagacaaaaaactcgagggacttaaatcaagagtctgttatactgaaggaaaaccgtgaaacaccttctcttgttaagagactctctcgtcgttctcgaagactcttcgctcgacgtgatcaaactcagaaggatacgctgcaagtgcaagctaactttaagacctacgcagaaaagatttcagagcaggacgaaagagacctttctttcgttgtctcgtctgctgcagaaaagtcttcaatttcgttagctttgtctcagggtgaaattaaggatgctttgtaccgtatccgagaagtccaccctctagctttaatagaagctcttgctgaaaaccctgccttgatagaagggatgaaaaagatgcaaggccgtgattggatttggaatcttttcttaacacaattaagtgaagtattttctcaagcttggtctcaaggggttatctctgaagaagatatcgccgcatttgcctccaccttaggtttggactccgggaccgttgcgtccattgtccaaggggaaaggtggcccgagcttgtggatatagtgataacttaaccttctaaagctctctacaactaagcttcctttccccaaaacaatagggaagggaagcccagaagtttttctctttggccttcctgaattttcataatcaatcgcaacaggagagacaatgttatattttatagaacagctaaataaactgagtacgtcgttttgtgtattccctatgatcttattgttaggggggttcttgacatggaaattacgcggtttacagttccacgggttaaagctcggctttaacttgatgcttcaaaataaattggatgatagttcatcaaaagctaacgaagtttcttcgtacgaagctgtagccggaatcctagcaggaaattttggcacgggaaatatcgccggaatggctgtcgccttagcttgtggaggtccaggcgccctggtctgggtctggcttgcagccctcctcggagctatcgtccaatatgctggctcctatttaggttcaaaatataggaaacctgaaggaaatacaggagaatttataggaggacccatagcctgcctcgcttttggcatgcgtaaaaaaatactcgcaggattctttgctttattcactatcatgacagccttctgtgcaggaaactgtgttcaggtaagttgtatcgttcctctctgtgcagaaggaactccaggaaaactcctcgttggaattctactagctctcgtagtgatccccgtgttagcaggaggaaataaccgtatattaagattctctgctcgtgtgattcccttcatagcaggattttactgtatttcttgcgggatcattctcttccaacatgcctcggctattcttcccgcaatcaaactgatatgctcttcagcattcggcattaaagccggactcgctggaatcggaggctatactctttcgcaagtcatctctacagggattaaccgtgctgtcatggctacagattgcggcagcggaatggtatctattttgcaagcaaatacaaaaagcaaaaatcctgttgtagacggactcgttactctagtccccccagtcattgtgatggttgtttgctctattacaatgctcgttctaattgtctcaggagcttacagctcaggagcccaaggaactctaatggtcatgagtgcctttaaaaatagcctcggctctctaggtagtgtgattgttattctcgctatggccctattcggatatacaacaatattgacatggtttgcttgcgcagaaaaaagtttacaatatatgatcccaggaagacgagcaaatctatggttgaaggctatatacgtcttgatcattcctctagggggtgttatcgatatgcgtatgatttgggccttatctgacacaggtttttctggtatggtcattctgaactgcatagctctaatcgccttactgaaagatgtactatccacaaaccgcgatgttgctttgcttaaagaacgcgagtgctctgttgcagatcctgtgcgtaatctagatgcttaaaggagaagaatcatgcaattattgtccccagcgtttgcttatggcgccccaattcctaagaagtatacatgccaaggcgcagggatttcccctcccttgacttttgtagacgtccccggtgcagcgcaaagtcttgctttgattgtcgaagaccctgatgttcctaaagaaattcgtagcgatggcctgtggatccactggatagtctataacctatccaccacaattactaatcttgccgaaggagctgaaatcttcgctgtgcaaggattaaatacttctggaaagcctgtctatgaaggtccctgtcctccagataaacagcaccgctacttctttactctatttgctcttgacgtagttcttccagaagaagaaaacgtcacccgtgatcagctatatgaagcaatggaattccatattatagaacaagcagagttaatgggaacttacgagaaaagttagaatttattcctcttcaggaataaattcctctcgcttcttcctgtgtttccaatatagcgggccatagtgatagcaaatttcttggcccgcatatatcggtgctactgtcctgataatcacgtgaaacaatccctcactgaaaaccccgatagcttccgcattaggttgttcgctgtgattgataaaacgtgtgacgtttccctgcttcccactatcaatagtaaaatatcttaaagtgaataaaggcatcggataacgaaaacaataatcgttctcatccatccaaattgcctgccggtgacgcaaaattcccgtgtattctccgatatatgtccaaggagcaatttcatcacgagcaaaaactccataccctacgtgcgcattaatccaacagacagaaaccggtggagctggaggacataatagatcttgcttgtgtagttttcctaaccacttggctagaggagaaatcaaacgacgtttttccgatttgtgacaaagagtctcaatttgctgttctaccttccagttagaaaaaactaaagaaggaagaaaccgaaaatgaagaagttcactcgctcggtctaaagaatacggctggctatctcgccaatcattgttcaaagaaatgtgtatagaagaacaaggttccgtagttaccgtggacatgcaacctcaagacgagaaaagtatattggagatgtaatgccctgcgctaatgcaatttctggtgctatagaagtgatagaagctatcgattcagatactgtagaaagtgctagctccgcagtgttacactcggtagacaggtgagcaagatataacttctttaacttcggagtgataatcttttgtaaaagctgaccacactcttggttagaaatatgacctaatttactcaatacacgctttttgtaaacatcaggacgttgagattgacgtaccaattcaggggaatgattggactcaattaataagtaatcacaatcatagagttcatgtgtgatccaagaggtgacccaacctaaatctgtgcaaaaacccagtttctcttcgcgataatgaaaaataaaagccacaggatctacagcatcatgaggtacattgaacgtctgtacttcgagatcttgaaaacaaaatgaagaccctgtggaaaatattttgaattctggatggctatctagtagatggcataaagcacgagccgtctccaagttgcaaacaatgggagtgttatacgccttaacaaaacttttaatcccggagatatgatcagaatgttcgtgcgtaacaaaaattgcctgaatatcttcaggatcgatattcatagagagtaattcccgagtgacgacttgcttgctcactcctaaatcaataagaatcttacaagaatccgtgcctagataagcagaattccctttggatccagaagctaaagggaaaaaaccttgcatgctaaccttccagaggattctgtatcaggatttgacgaggcttagctccttccgaaggcccaataattctagcttcttcaagttgatcaattaaactagctgctcgggcataaccaatttttaattttctttgaaggaaggtggttgaagcattccccgtctgtaaaattaaggttttcgcctgagcaaataaaggatctttttctccagagttatcagaatcagaatcatcaaaagcatggaaagaaggaatcacatattgtgtagggaatctagaacatagatcttgaatgactttgtttatgtcctcatcacaaatgtaggcaccctgagctcgtatagttccaaaaacagaaggaagaagtacaagcatatcaccatttcccatcagattctctgcaccaggttcatcaatgataatctgactattcactttattggagaccttaaaagaaattcgagaggggaaatttgctttaattaaacctgtaattacctctcttgaagggcgttgcgttgctaaaatcagatgaatccctacagctctagccatctgagctaagcgaatgataggagtttcaatatcttgggatgacgagagaagcaaatcagataactcatcaatgatccctaccataaagggcatagtttcacgaatctccctgtcgtaagaagcctcaatcgttttattgcgagtgcgggagttaaacgcttgtatattgcgcaaacccaaatatctcaaaatctcataacgagattccatttccttaactaaccaaactaaagcattgtacacttctcttgattcggtaatcacaggagataacatatgaggtaattgcgaatacccagtgagctctacttttttaggatcaataatgacgagtttaatttcagaaggtaaggtcgtcataatcatagacatgacaatcgtgttaatacatacagatttcccagatcctgtagtaccagcaataatgagatgaggcatcgtagctaaatcagcccaaagattgtcaccatttgctttcttccctaacaacaagggaatctgcaatttacgatttgtcttctgatagtcttctaataaatcacgaaaattcacagcttgaggaaaaggtgtgggaatttcaatacccacagcagctttccccggaatcggagcaataatccgtatgctcgaagcttggagttttaaagctatatcattttctaaagatttgattttctgaaccttaactccagaatgaggtaacacttcaaaagctgctaatgtcggtcctgaacagatgttgccaaggtccgcatcaattccaaaactcgtaagagtctgttttaaaatcagagcttttctctctagctcagcttgtaaggactcgggacgagcttctctgtttttactaagtaaatgatattgcggaagatcattttcagggactgctaaactttttaatttaggaagagccgctctttccttgcctttggattccctcactacagtgggagtcgaagatagcgcaattgttttcccttctttcgctttattctcttgaggctcaacaaattttgtcaggaaacgcttgcaaggatgaggagttaggaaaaaggactctttcttagaaccggggatctcttcctgaggtaagggagaaatagacccatctaaaatgatagtctcagaaactcgacgtggcgaaggttgcgatttcgtacaagaaaaaggattcttggaaacaaaaggaaccgaaggcttaggaagatagtttcgcctatttattaatttttttaaatttttgaaacaagtttggaaaaaagagcaaaaagcctttttgaccccgtcttgaaaggtttttttttttaataaagcaatgcctccgcaaagataaaggacggagaatagcatcacgaatccaaaaattagagcagttcctacagacccaattaaatgttttagacaaaaagattggccttcgtaaaacagatagaaagggattccacccacataagagacaggaggattattccctaaaataaactttggaagacgtgtatctaataaagcaggaagcgttcctactggagataacatggataagagaatcgcagaacaaaaggggagagaaagaaatgccgcagctttatagaagaaaagcggtcgaggagtccttctgaagtacaaaaaagataaccaaagaaaatataaagggataaaaaatgccgcggcaccaaagaaataaagtagaaaagaactaaatgaccaacctaatagacctatccaattctgtgtgcacggctgatctctatgaaaactccatagactgagaccagaaaaacacgcgaaaaataaatataaactggctttagctgctaaaggcaaagtcggaagacgagggtgcctgctcttttttctttctcttatcatgggctacataagattctaagtattgtcgagcttcgttatagatttcgttatatcaagaaaaacaaaagaaacaaagaagataaagagggcgaacgacggggcttgaacccgcgaccttcggaaccacaatccgacgctctaaccagctgagctacgttcgccaaaccatgtaaaattaaggaaaatattagcttcagtctgaaatttagccaagataaaaaggtcagaataggaaatctcaatgttctcactaagataagtagtatgaatttcttgaaaaacagcaaacataacgttctttgaattcaaatagaaaaccaggacagggaaaaccggagctcattgcgaatagaaatagggtttatgaataaaaatgcattatttttttcgcgaaattttagcccttacagccccttctggagcagaaaatggttttttgcaaaaaaagaaaaaaataaaaagcaaacgaaatgcgttgcgaaaaaaatgccattttttataggatgttgctttcttcttaagtgaaacaaacaaagaagaagagtccacacttcgatgtggatacgcaacgaaagtttgagtatctgtagtttataggtttttaaatttttcttcttaacaatgcaaatgagatagaatgcaggccagtataaaatgcttgtgaggatcttttgaaggatctgttaattttttttattttttctgagaatttgatcttagttcagattgaacgctggcggcgtggatgaggcatgcaagtcgaacggaataatgacttcggttgttatttagtggcggaagggttagtagtacatagataatctgccctcaacttggggataacggttggaaacgatcgctaataccgaatgtagtgtaattaggcatctaatatatattaaagaaggggatcttcggacctttcggttgaggaagagtttatgcgatatcagcttgttggtggggtaaaagcccaccaaggcgatgacgtctaggcggattgagagattgaccgccaacactgggactgagacactgcccagactcctacgggaggctgcagtcgagaatctttcgcaatggacgaaagtctgacgaagcgacgccgcgtgtgtgatgaaggccttagggttgtaaagcactttcgcctgggaataagagagattggctaatatccaatcgatttgagcgtaccgggtaaagaagcaccggctaactccgtgccagcagctgcggtaatacggagggtgctagcgttaatcggatttattgggcgtaaagggcgtgtaggcggaaaggaaagttagatgttaaattttggggctcaaccccaagtcagcatttaaaactatctttctagaggatagatggggaaaagggaattccacgtgtagcggtgaaatgcgtagatatgtggaagaacaccagtggcgaaggcgcttttctaatttatacctgacgctaaggcgcgaaagcaaggggagcaaacaggattagataccctggtagtccttgccgtaaacgatgcatacttgatgtggatggtctcaaccccatccgtgtcggagctaacgtgttaagtatgccgcctgaggagtacactcgcaagggtgaaactcaaaagaattgacgggggcccgcacaagcagtggagcatgtggtttaattcgatgcaacgcgaaggaccttacctggacttgacatgtatttgacaactgtagaaatacagctttccgcaaggacagatacacaggtgctgcatggctgtcgtcagctcgtgccgtgaggtgttgggttaagtcccgcaacgagcgcaacccttatcgttagttgccagcacttagggtgggaactctaacgagactgcctgggttaaccaggaggaaggcgaggatgacgtcaagtcagcatggcccttatgtccagggcgacacacgtgctacaatggttagtacagaaggtagcaagatcgtgagatggagcaaatcctaaaagctagccccagttcggattgtagtctgcaactcgactacatgaagtcggaattgctagtaatggcgtgtcagccataacgccgtgaatacgttctcgggccttgtacacaccgcccgtcacatcatgggagttggttttaccttaagtcgttgactcaacctatttataggagagaggcgcccaaggtgaggctgatgactgggatgaagtcgtaacaaggtagccctaccggaaggtggggctggatcacctcctttttaaggacaaggaaggttgtttttaacaacccgactaggttgggcaagtattttatattccgcattctatttcttttgcattgttaaggttgttttcaaaacattcagtatatgatcaagtatgttatgtaaataatcatggtaacaagtatttttcacatataataatagacgtttaagaatatctgtctttaggtgaagttaacttgcatggatcaaaaatttacagaccaagttgttaagagctattggcggatgccttggcattgacaggcgatgaaggatgcgtttacctgcagtaatcttcggtgagctggtatagagctatgacccggaggtatccgaatggggcaacccgatagactaatagtctatcattatatgttgaatacataggcatataaggcgacacccgctgaactgaaacatcttagtaagcggaggaaaagaaatcaaagagattccctgtgtagcggcgagcgaaaggggaacagcctaaaccatatttttaatatggggttgtagggtcgataacatgggatcttaagttttagttgaatacttctggaaagttgaacgatacagggtgatagtcccgtaaacgaaaaaacaaaagacgctaatcgatacctgagtagggctagacacgtgaaacctagtctgaatctggggagaccactctccaaggctaaatactagtcaatgacctatagtgaaccagtactgtgaaggaaaggtgaaaagaacccttgttaagggagtgaaatagaacctgaaaccagtagcttataagcggtcggagacctataactcttcggagtaatggttgacggcgtgccttttgcatgatgagccagggagttaagttaaacggcgagattaagggatttacattccggagtcgaagcgaaagcgagttttaaaagagcgttttagtcgtttgatttagacacgaaaccaagtgagctatttatgaccaggttgaagcattggtaagactttgtggaggaccgaaccagtacatgttgaaaaatgtttggatgagttgtgaataggggtgaaaggccaatcaaacttggagatatcttgttctctccgaaataactttagggttagcctcggatattaagtttttgggggtagagcactgaattctagcgggggcctaccggcttaccaacggaaatcaaactccgaataccaaaagcgagtccgggagatagacagcgggggctaagcttcgttgtcgagaggggaacagcccagaccgccgattaaggtccctaattttatgctaagtgagtaaggaagtgataattctaagacagttggaatgttggcttagaggcagcaatcatttaaagagtgcgtaacagctcaccaatcgagaatcatcgcgccaataatgatcggggctcaagcataaaaccgacatcgcgggtgtatattatgtatacgcggtaggagagtgtagtattcagcagtgaaggtataccgaaaggagtgctggagcggatactagtaaagatccatggcataagtaacgataaaggaagtgaaaatcttcctcgccgtaagcccaaggtttccagggtcaagctcgtcttccctgggttagtcggcccctaagtcgaggcacaaatgcgtagacgatggagcaacaggttaaatattcctgtaccacctaaaactttagcaatggaatgacggagtacgttaagcacgcggacgattggaaatgtccgtatcacaatgagactggttagtaggcaaatccgctaacacaaggtcgggttgtggttaagggaaatcttcggaggaactgatagtgtggcgcaaggctttcaagaaataatttctagctgttgatggtgaccgtaccaaaaccgacacaggtgggcgagatgagtattctaaggcgcgcgagataactttcgttaaggaactcggcaaattatccccgtaacttcggaataaggggagcctcttaaggtgattacccagcggtatgagcctcggggggccgcagagaaatggcccaggcgactgtttaacaaaaacacagcactatgcaaacctctaaggggaagtatatggtgtgacgcctgcccaatgccaaaaggttaaagggatatgtcagccgcaaggcaaagcattgaacccaagccctggtgaatggccgccgtaactataacggtgctaaggtagcgaaattccttgtcgggtaagttccgacctgcacgaatggtgtaacgatctgggcactgtctcaacgaaagactcggtgaaattgtagtagcagtgaagatgctgtttacccgcaaaaggacgaaaagaccccgtgaacctttactgtactttggtattgatttttgatttgttatgtgtaggatagccaggagactatgaacactcttcgttaggagggtgggagtcattgttgaaatactggtcttaacaagttgggagtctaacattactccatgaatctggagaatggacattgccagacgggcagttttactggggcggtatcctcctaaaaagtaacggaggagcccaaagcttatttcatcgtggttggcaatcacgagtagagcgtaaaggtataaaataggttgactgcaagacttacaagtcgagcagagacgaaagtcgggcttagtgatccggcggtggaaagtggaatcgccgtcgcttaacggataaaaggtactccggggataacaggctgatcgccaccaagagttcatatcgacgtggcggtttggcacctcgatgtcggctcatcgcatcctggggctggagaaggtcccaagggtttggctgttcgccaattaaagcggtacgcgagctgggttcaaaacgtcgtgagacagtttggtctctatcctttgtgggcgcaggatacttgaaaggagctgttcctagtacgagaggaccggaatggacgaaccaatggtgtgtcggttgttttgccaaaagcatagccgagtagctacgttcggaaaggataagcattgaaagcatctaaatgccaagcctcccttaagataaggtatccctatgagactccatgtagactacgtggttgataggttgggtgtgtacgcacagtaatgtgtttagctaaccaatactaataagtccatagacttggtttttatcatataaaaagctgaataagcttttttgttgaattagtcgatttatgcaagtttactaaagactcttcttaagcgtctattagtatacgtgaaaatacgttacaagatttagcttggcgatactggagaaagggatacacctgataccattccgaactcagaagttaagccttttatcgctgatggtactatacacaagagtatgggagagtaagtcgttgccaagctttctattatatgtttcttaatacataattaagaatttcaaaagaggataatttttttatcctctttttttttgctgttttttgataaacctatttacccagcttgtttctatttaaaagtgatttcattgtttttaaaataaaaaattcgctgtacacatgcccgttcctatagataattcctctcgcaacctacaagaagttccagaaagcctagaagacctcgaacaacacgcagaagaatctcctactcatcaaagtgcagaaagcagttctttgcaactgtctctagcctcctcagcaatttctagtagagtagaacaactatcttccctcgtcttaggaatggaaaattcagatttctcctctttaagagacgttcctatcttctcagctatctacgaatcttcaacacacacacctgtccccactcctctagttggcgtgggatatatcaacggaagtcaatcaggatactacgatacacaaagagaatctcttcacctcagccaattgttaggaagccgaagagttgaagttgtctataaccaaggaaacttcatggaggcctctttgctaaatctgtgccccagaagacctcgaagagatccctctccaatttctttagctctattagagctctgggaagcattttttttagaacaccccccaggtagcacttttaatccaatatttttttggtaacggagctttctatgttcgcgaagctctccgcctaactccgcatgcacagaatatagtgctcgttggtatctgtccttctctatatccagaacatcctcgctccttttattatcgtgtttctggagatataggctcccgattcgacgatagaggatttgtaaactctggagtcgaaaccctgccatactcttcaggcagctttgggattttttggatctcgtttacggatcccacatttaattttgctatcgtaaatacctttatgcgaactgcagggatcaatgaagtctctagacccatgacacaagatacagaaacttcattgatagaaatgagagacctaagtgaacaacaagaagcgaataacacagattctttagagcaagaagagagcttaatgggtattgtaggacatactgtgggaggagtttccatgaccgtgacctccagtccaaatatcttttatcgtatacaaacacttctgggactgccagagactcttgcagaagctgaagaaaatcctaccttcccaaattctactatagatagccttgcagaaataatgatgaacctcgtaaggatctctgatgctgtctctattttctggatttttcctatcgtagatactacatataatggagttttattagccgtctgtatcggcttcttcggaatcaatgggatttgttccacgttccttatgcttacgaatccacgctctcgtcgagatagatggaggaatttacgcatcatggttctttgctatcgttctttgggaagcggaatgaatctctttgatcttagcaataatgtgcgcatggcagcacgtaggcatgtgacatcatgtacagtagctctctatgctatggtcactctatttggatggacagtagcaatacaagatgctttgcaatatggtttccctagcgttcgggatgccttctatagatattgcttacgccacagatattgcttaactcaaagaaacgaagactctctgcaaactacaggaacgcgctttcaggttacccgtacacatctagaagatcaacagatggtggcttctattttgaatttgagtgtttttgggctcttttttggattcgtagggctaatgaccacgtttggaggattagaaatctcaccatcttgtcggtgggatgcagcaaataaccgaacggtaggtattttttagactccaatgttaccttttctcaagctttaagtagtggtcgtgtctatgcagtcagccaatcggtgcatatgatcttttgcttcttctctattatcttatatacgatgtctctactttctcttctaagaagacgtcgtcgtcaataaagaaaaaccagatccactagcttccaaaatcatcaagaataatcgaactgcgctcgaccccatagtcaccaagaagtttaagaatactgctattgtgtagcggtggaccacatacgtagtaaagatagtcttcaggattatctaacctactcaattgacctagattaaatgcccgaaataggaagtttgtctttgtagggtcatctttatcccaacctgcagcaatatcttcaggaagaggctcagaaaggactaggtgataatggaaattgggaaactgtcgttctaaattttcatattcttcttggtaaatgttctcttttaatgagcgcgccccataccaaagatcaatttctctcttggaatgcttgtttaaaagtaaatctaggatgtggctcctaccaaaagatgaacctgctcctccaattaggaagattaaagggcggtcgtcatctttcataaaagattctccataaggcccagaaactgtaattttgtctccaggttttaaagagaacacataggaggaacagactccccaagggatctctgaattaggctttccattaatgaaaggaggcgtagcaatacgtatattaaacttaattgtaggaagctcggcaggataggaagctaaagaatacgctttgttggcagaatccgcaggaagttgactgttgtctataacttgatcaaatagatgaaagtgttcccagtcgctgtaatactcaggagccatagtttgcttccaatcggaagagttcgttttatagctcggtactgtaatttgtaagtagcccccaggcttaaagggaataggtttatttgggtctacagcaacaacaagttctttaataaaggtagccacattgtcattagagataacagtgccctcccaagaagaagcatttaaatatctctcttcaatttctaaactcatgtcgtgctgaactttgcactggcaggaaaggcgccagccttcctcgagttgtctttttgaaaatgtagaacggtccgtttctaaaggctcatcagcatttttaacaacgcgaactttacattgcttacaggtggcttttcctccacaaggggagggaataggaattcctgaacttaataatgaaactaagagagtctgaccactttcgacagtttttgtcagttcttcattgtcgttaatctttaatttacaagggtgtaccttaatgaaaagcttgcgagatagaaggatcacacctgcaagaatcacgccaatggcgcaaaagataagactagcaatacaaatgaaatagaggcctgaaagccaagtcataacgataaaaatcccagactttatgaaaagctcatagagtcaaattataacttagcgcataaaaaagcaataaaccttaagacaataaataagaaatcccacgattttaatcgtgggatgaaagtctcaaaagaaattccttatgatttgttatcgttaggcttgaggatttcagaaatagctccttttaaaacttctacttttccagaagcaatatttaaaattaccgtgtgctcacggatatcgtcaacagtgccgatgattcccatggcagtgactttatctcctttagcgagatcattcttacgcttttccatggcctttctgcgtttttgttcgggacgccataagataaaatagaaaaatagaatagcaattgccaacatcacggcaggttgcacaaaagtattttttgattgagctgcttcttcttctgcaaacaggggcaaagagctcagtaaaaatagaaaacatgtcactatacgagaaagcatgcaatcaccttaacttgggttaattcgaagtaagattatcataataggaagcgagcattcaatgcttttcctagggatcgatctctctttctagtaaaataatattttctaggtgcgtcgaatagggaaattggtcaataggctgcatcttttttatgcgatatcccccagagattaggtccgcgcactcttgaaactgtgttttagggttgcaagagatatagacaatttttggagatcctatacgtaaaatatatttaagtactttactttgcataccacaacgtgggggatcaataataatgacatcaggagctttacaattttcattccttttgcagaacgctttcgcatcttctaaatagacttctacgcaatcttctttgttattcgctttgatgttctcctgagccgaagctacagcatcaggaataatctcaacgccaatcacatttttgacatagggagagagcataatccctatagttcctgctccacaatagagatcaagaagcgtttccgaaccctcggggtttataaactctttcgcagtttctataattttcgctgcctgagtaatctgaggttggaagaaacttctgggacgcaaactaaaagaggcagagttaccgtcactaggtaaggacagtttttgctgtatcgagggggctccgtatagcagtttagtttcataatatgtagaaatcccacgtgcagctaccttttcttcccaatagatcgatgctatgtttagagaagacgataggagaatctctttccattcatctatacaggcttcgtttaccctatattctggagttcctgatgttgttaggatcaccataaagttttgctgcgggctccccgtacggacggtgagtgtgcataacgagcctttgtttttaggggggaagtacgccataagctctgggtgcttatcccaccattcgcgagtgagttttaaaatatccatagtctgctcatggataagcagacatgtagtcactggaattcctttctttggttttgtagagctgatgaatcctaaacttttttctccttcataagtttgaaaaaaggagaattccattttatttcttcctcttaaagagggagaacatgggatgataggagcaatcatatccgagggaactaaaggagcgaataactgatgaaggagttcttcctttttctttaaggagtcagaataattggactgaggaaacgagcatcctccacatacaccaaaatgtggacaattttgcatggtagacatagttaagatagaagcttagtttttgttagagaggtaatctgagaactagacaacaattcacaaggaccttcatttcgaatccctagatgagatacttgaaaggttgtttgagaatatcaaaagcaaaatggaaattttatcacgaaggaaaattatatctctacctttttaaggaagaactcctaggtagcacagagaaaaatttgggcataaaaaagaggatgagtagaaaattacccaccctctaaacgaaatcaagctaaggcgaattattttctaaatccgcgtgctttggaaggttttttaactttttttgcggctgtctttttagatgcaggtttagaagctttgactgctttgctagttttagctgcagcagcagagctttttttaggggcttttttttccgcagttttttttactttggcaggagccttagttgatggcttacgttttaataacccagatttctctgcttttatagattcttttctgtaaagtttcgcaactttttctaattttatagagtctgtgcgtactctttgagctgctgccttgtttcctttctctgctttagctaagtcgtgttggatgctatccagcaggtctttcattttttttgccgtatcttttagcgccatgaaaagcgtcctctagtcgctgttttaaactatttttacttgttttaatttttaattagtttgtttgttcaaattcatgcaaccattttttagagaaaataagacttttataagttattgttattttgttatgagaacacacttctttgtttatcaatgtgttaatttataaaatgtttggaaaatccattggaaaaagcaaaaaactttaagagaggatttgggtttttttttcgtgttttgagtaaaatggagaacgtatttgtatcaatttttgtagcatgtagagaaaaacatattttctttgatcattgggaacgtagtttctatagatcgaatgtagttcaaagaatgctaccccccaaatcctttactttcgagaaatgtctgctataaaaggaatagaagtatttagatgaagaagctatatcaccctaccttatttctgagacctttgattcggctgagcctcatttttgcgttaagtttgacactgatttcaggaaatttcccacagcagaaatcctttggtcattgctgtgcagatatgcactcagcattaatatcagggaaaaattgtgaagaactctttgcagattttattgagcgggttcttgccgacagagagactttgactgcccgtgattggggaactgttgttgtcttagtccgcgagtatctcttgaagtgtattcgtaaaggggattgtgactatggagtgaaaattcttcagaaactcctagccttacgcttgccgaaggatgctaggaaagacttgcagatcttatggcaccggttgaatccagagcaggctcctttgcgagatgttgttgatcagcttttcactataggctgtcacgaatctttgcaagatcacttgctttttgagctctacaccgtgacattgcatagcggttatgaaaaccgtaaacaggatatgcttttagctaaagaacaaggggattacaaaaaagctatagaattggcaaaagagctggttgcagcattggaaaagggatcgtgtagccctcacccagagatagtgcaaatagaaaaaacttttttgcaaaaaacactgcttgctttgcaaataaaagtagcacaagaagctcaagaatcttgcgatgctttactcacaccctactgtttgtctgaaattgcctatactgaagctatggatgctttggtactgcgtatagctagaggtgaagtctctcgtactaatgaggtggatagtgtcttactgagccatgccttacaacacctccctttcgcacgggaaaaagcgattcctgaacttgaagttcttattgatcacggagcctatctagaatccacattactatactatgcatacttctctttattagaactttatcatcaaaataaagactttgcatcgctagagcgtttgctagagaagggtgatgctgtctttgtccctgagcatccctatttcccagaatatgggttttttctaggtgcatatttctatgctaaagggaaatacgagagcgctgagaaagttttcttacagattatagatcccgctgtaaaactaggagctacttttgctagagcatatgaatatctagggtgtattgcttatgttcagaatcattacgagaaggcggaagaatactttctccgtgcttataagagttggggacgcgaagagtcaggtataggattatttttagcatacgctgtgcaaaagaaaaagactgcatgtgaggatatgctctaccatcctaagttttcttttacctaccgtcatttgctagattctctctgttctttatcgtatccacatggggaaaataagggcagctctgcgatccaaagagtccatagggctgtacccgagctttcagagatttatagccgctgtatctatgatatgattaaatataggaatgttacctatacgcaccctattatagagcttgcttacaaccaagtccgcaatttagaaaaacgtaatttagaagaaatttgtagggatgcgcaagatccagaatatgataaagctttagccttttggggagcccttcaatcgggggcctctgtgccaaggtctctcattgaaagttcagatgtggatgaagccagaatcacaatacgttgctatgaggctttatattttcacaatccagatgctatagctatgcttcctcaagcgttttctgaagaatgtaattcttggcaaacggcactgcgactcgtttggacgttagtacgacctaaaggagctcctaatcacgctaagtattgggatcaccttgtgctccgtccccatggggatagcctatatttttttggttatgaccttcaagaatatctcattggcaaagaagatgccttgaagcatctgtctgtatttgcggaactcttccctaaatcttcgctgctttcgcttgtatactatttacaaggctatagcgaatcctcggctttgaggaaagtcggatggtttgtaaaagctcttgaagagttcactgagatttcttggtcgggagagcatatgaagacatgggcgtatatctattatatggtgaagttagatcttgctgatacctatatctctttaggcaacttttctcaggcagttcatattcttgaggaggttaaggaagattggcaagtcgccagtcatcccaaactacatttccttaagggagaggactgttacttagctatggaactgcgatgggtagagggattggcctatgcgtactttcagttacatgagaccgcacacttgtccaatcatcttcttgagcatgtagaaaagaatttaatttccccacgttcttacagagactattatggcgagtctctacagagaactctggggttgtgccagcgtttcctcggtgtgtaaatcacagatagcatgatatgcagaagctatacatcgattcagtcctgggcctgcaatattttgacctacaatttttaaatttcctggtaagtgaggtaggatacgctctttcctttctagaaagccaacagcatgttgtggcatgccatcctgagatgaaaataaagcaaaagcatctggtttttgattgatattcaggtattctgagagagctgctatcgcaaaggcatgagcttctgattcccgccatttgccttcaatgagaagggagagcactgttttccctggcgtagcttgcgggaagatttgagaattccaaacgattcccaagaggggaagctcgtctgcaaatagcatgccataacctttgggaagcgaaaagttggcgtgatgccaacctaagctgatgctagataaattccaagggagaactcttttagataaattttcaattccatagttaggaagcaatacaggaagctgctggagaggtcctgtataaattaccatatcggcaaaaaacgtctctgaaggtgtggttacacaagcttcttttggtgaacaatcgatgtgagtcacactagtagaaaacttccatgttgcggggagtttttcttggatagtagtaatcaaagtccccatggaaggagatagagatgcaagatatctgtcggtcttagactttttgggggatctatttttaagataactgcgtaatagagacccgctggaagcttctctctttgctagttcaggaaatgccatgtgtgtggagagaatgctgctatggcctgcgcgtatggctgtgattagtggatctaatatatagcttgtaaaattttgtgaactatgtcgctttaagaaatcctgaacggaactatcttgagtatagcaaggtgcacggaagtccttaattaaagaaggaagcaggccctttcttaggagagtccaggtggatattttatgggccttccctctgtagtagacaaagcggttttttgctgcacgatcactgaagatcaaggaattttggagaccaagttcatggataagttttagagtatactctccgtctccccgggtgaggaatcctttaggtccgaggtcaaaagaaaacccttgaggggattccgtgcggacgaagcctcctgcgtaggcttctttatctaaaacaaggatttccgcttgggggaatttcttatgaagccaccaacctgcagcaagaccagaaattcctgcgcctataatgattgctctcttcacacaaaacctcctctctgctcagtttctcaacatttttatatagaagctgagaaacattcttttttagataccttattgagaaaatagtgatcgaaagctgtggcaatgactctgacaaacaattctccaagaggagttactttcaaagagccaggactgttatggatgagacctgtagtttccatacttatcaagcgatcacgactttctataaaataagtatcaaactcatatccaaaaaggttgaaaaactcttccttattgatcgtaaacgtgcacatcagcttatggattgcccattttctaatccgatcatcctcggtaagaattttacttttcacagtggcaaatgttcctcgaagcaccgtattgtgatattcctcaagggtttttgcattttgtagataaattccacgaatgaagcttgtagaagtcattcctaacccgagcagatcttcttctgggggtagagaatacccctgaaagttgcggattagagttttgtttttgaaagcgagggtaagaggatcatggggaagagagaaatgatccataccgatggcctgatatcctgcttttgtaagtaaatgccgggattgagaataaatcgcgaatttctcttccatagaaggcatatccgaagctttcatggctttttggtgcggcttgatccatggaactgaggcaaaagaaaataaagcaagacgatctggatacatcgctaagatatcttgaattgttttagaaaaggactccttggtttgtttgggaagaccataaattaagtctatattgatactttggaaggcgagttccttaaatttttcgtatgcctttaaagattcctcatgcgattggcgtcgtcgtacagcttcttgaacatcagcttgggtatcttgaacgcctaagctaaccctattaaaacctacgttctgaaagaaatctgctttttccatgtcgtttcttaaagaacgaggatccacttcaatagcaatttcttcagcatgtgaaagatcaaaaagcttatggatgtggtcaaaaagcagggtaaacaactccctggagagtctgctaggggtgcctcctccaaaatgaatcctggatacctgaggccggaatcctatggtctcaacgacaagtttcatctcttggattagggtgttgatataagcttctacaatatcttcacgacgattcaaaacaacagaacaaccgcaatacaaacacatggattggcagaaggggatatgaaaataaagagagagaggctgaggattttctctaattctttggaacgctagaagagctggagccgcatcggaaggttcccattctaaagctgtagggtagcttgtgtatctgggcgcgggttgatgaagtccttctaagaatttaaagttgacgttgaacataagaaactaccaattggacgttttctaaaggtgtttcaggaagaatcccatgtccagaattaaaaatgaagttaggatatgttcttaaaggaacaaggaaggcttctacatagtgtaataatttctcttggggcaataaaaatattgccggatccaagtttccttgtagggagagcataagatttttttgtatgcgatgaaggtccacatgataatcaggatggagtgtatcggcttgcgtggcttgcagagtataaaaattttcttcaaaacaacgacaaaataaactcacaggaatggcctgctctttaagttttgctatcagacgacggtttggttcagtcacatagcgtgtaaagagtgctgaagggagacgtagactcgaagattcaaaaagctgcacagcagcagctcctgcatccatttgtgtttttagataaatagcagtcccttcgataattgtagagatgagctgatcaaatttttcaggatacacatagagaaaagacatggtcttagaaaaatctttggaagcacctccatcaattaagtagcaggcgagtgtgaagggagatgctgcaaaaacaatcagcggaacaggaagtttttgcttaagagttcgaatcgcgtccaaaagatagctaaagatggtttgtggatcggaagtgaaagtgaaaggttgctctggagaaaattgtatgcgcggaccaggagcaaagtcataggtcacagcaaaaccatccaagatggataggatatcagcaaagagaatagcagcatctacatgtagcaacgagggccctaaaagcgtagcctctacaatagcttcagtattatggaaaaaggtttttaaagattgggatcctttcagctcttggtatggaggcatgtaccttcctacctgtcgtaatagccatatgggaggatgagaggcagtttgagattttaaaagatcaaaaaaagcagacatagagtcccaattatgaagcgttgattaagaagcccctttctatggactcaatgacttctttgactagaagttcaggagttggagatagagcatagggcaaggttttctttgtctgttcagatttgctaaggcatttttgcacatataaagcattcgcagttcccttaatgctagaaatgccatgctgcaaagcaaataggcgtatttcagcaagggcaaaaagccagcagatctcttgaggtaatgggccaaagcgatctcgcatttcttcttgtattgcggtaagctcttcagagctttcagcattaccaatcttttggtaaaactcaatgcgcatcgatccagtttcgatgtaagtatcaggaatacgcgaattgtaaggaaattctattttcacatcgtcgttgaaaagtaggggggacgtgtgtttttttaaagctgaaacagctttttttagtaatttgcaatacaaattaaaccctatagttccgatatgtcccgactgatcggttcctagaatattccctgcaccgcggatttctaaatcatggagggcaatcttcattccccctccatattcctgcttatttaaagcagcgagtcgcttcgctgctggcccagacaacctgtctaagtgaggaactagaaaataacaataggcctttttattccatcgcccgacacgtcccttcatttgatataaatccgccattccaaacttatcggcatgatctatcaaaatggtattggcgtttggaatatcaatcccgttttctatcagtgcagtagcaacgaggatgtcggttttctgatttttgaatttcgtaaagatattagagaggtcctcagctcccatttgaccatgagctacgccaatacgagcctcaggaatcagattgcgaatggtctcagcaagagtatagatgctctcaatccgattatgaatgacataggcttgtcctcctcgaaggagctcgtgccttaaagccgctgtcaatgtttctgtattatgctccatgacaaaagtacttacaggcaacctatccaagggaggcatggcaatcacagatagatcacgagctcctgatagagacatgtgcaatgtccttgggatgggagtcgcagatactgtaagacagtcaatcatgggatagcgctccttcagattgtccttaactttaactccaaagcgttgttcttcatcaataattaataaaccagggttcttaaactctaggcttttgttaatgagtttgtgagttccaatgataatgtcaatttgtcctgaagctacttgctcacagatgagtttttgcactttggcttgggagaaacgtgaaagcacagcaatttcgatcggcaatcccgccattctttctttaaaagtttcatagtgctgagttgctaaaatcgttgtgggaaccataacaatgacttgtcgatggccatcgcaaacagccttgacagcagcccgcatgatgacttcagttttcccaaagccagcatctccgcaaattaatctatccatgagttttggagacatcatgtcattgtaaatctgatcaatagtctttaactgatcgggggtttcttcatagggaaacgtttccgcaaacttgattacggactctccgtgaggagggtacacaaaagcaggagttgtcgaacgttgtgcttctaactgtaagagcttctctgcgtagacaatcaaagatttttcagtaagatctctagagcgcttccatttcgaactatttaaatgatggagatcggcagctttatcagaagtcccaacataccgagagatcagataggcttggttcgaaggaacataaagccgagctttatctgcatattctaaaacaagataatccgtttcaatattcagatggttcggttttttttctattcctaggaattttccaattccattatgaatatggacaacagtctctcctggaatcggaacaaaaacttcttcagtagtcactgaaaagtgagtgcgttgtttttgcctacgcaatacttttgtagaagcaaactcggatagggaaatcgctgcaaaggcttcgtttactaatgcaaagctggaagttagattccctgttttttcatagatttccacatccccacgagctacagtctctgctagagcacgggcctcttttaaagatttcgtttttgtgctgtagatggctaattttaagggctttccatgaggaggcatatattcttgaagatgctgtaggaaagcaagtaggggattctcatcgttctgaataatttgctcaggatacagtataggaatcgcttggcgactcgcttccatgtttcggtgaaatgcttcgatgatgacgcggttttccttgagattcttgacgttaggaaacggagtctccgagaaataaacttgattagacgttgaaatgcgatcgtagagagtgccaatagagaaaaatctatctggaagggacgaaagtgttccagaaatatccgcaaagtcatcttctagaatttctaagttatcaaagagatagagaggaggggtgctgaaatagtctaatagtgaatgagaatagtttcctccagaggcctcttctgtgtacgctggagagatagaaattttagagacttttcctgtcgatagctgatccgaaggattgtaagatctgatagaaatgatcttctctccccaaaattctatcctaaaaggctctggcgaggataacgggaaaatatcaacaattcctccgcgacaagaaaattctcccttttcgctagttagcatgacctgagaatatcctaaacttttacagagttccgtagttgcttctggatctaagacatctccaactgcgagatcaagatgttgttgacttgtagcttgtggagaacgggttttttctaaaagagcttttaatgtagtgacacagaatataggagccctgtgctgattcaagctgtaaagaagatgatctcgcttccccacagcatctatgttcactaattttggagagagatcaatttcagaagagggaaattctacaggagcttggtctaaaaaggtccttaaattttcaaagagatcatcaagacgtgcgggtgtcgtaatcataattacagaagcacgacagtcatgaaacatctttgctgcaaggaatgccgtggctcctggatgaatattttctaatagtaaaggaagtgtttcctctttgaattctttggaaatagaaaaatctaaattaactgggttgaaatccattgccataaagtttcatttaatacttctgttgctgggagagcgggagcactaccttgggccgattgatcttttcctccccagcgaccaccgcaaggagtaagaacagctttcaataaatcctgagcatggacgccttgtgtgataaggtcgtcagagactcgagatagtacaatatatttcccatttttctctgttgtccacagagaaattagtttttctggaatcctttgatgcaaacattgtgcgtactgctgcaaacggtggttctcatgttctgcgagatgatgcacgaggcaagtgattccttgacgttgatgacaattgtggattaacttgtctaattttgtctgaatcagactgttttctaactcatttaaccgtttgtcttgttgtttgcgctcatctaaagttgcagttagcctggagacaatctgatccctagggacttgtaatagcgtagcaatctcttctaatacttcgctttgttggtgtactgtagcttcggctttttctccagtgaccgcctcaatacggcggatgcccatggccacagcatgttctttggtaatccggaagaatccgatatccccagtagcttccgcatgcgtgcctccacaaagttcatgagagtgccctgcagaaactacacgaaccacatcgctatacttatccccgaagaattgcttgatttctgatgagttcatcacatcagaatagagagcttcacgaatatctacaggctcattctcccggatactttcattgactagagtctcaatacaaagaagatcttcaggtgaaattgcctgggggtgagtaaagtctaaacgaatttttgtatcgtcaacataggagcctgcttgacggatgtgatcacccaaagtgatttctaaagctttgtgtaataggtggcaggcagtgtgattgttggcaatcctctttctacgataacgatttacctgagcagtcactgcagcttctacagtcagacttccttgggaaattcttccatgatgtacgattaacccggcttttggagatgtcgtatgggtaacaataaaggtcccctcactacaaaagatctccccagaatctccaacttgtccccctttttctgcataaaaaggagaaacttttaatacaatagcaccctcttgcttctcttgaagcgaagaaactatgtgatctttagaaatgatagcttcgatgaacgtatcacaagagagatgatcataccctataaattctgaagttaaatgtagttcattgtagatagattccgaagtcccttgggattgaactacgttttttctagaacgttctttagcttcttgctctaacttatggaaggtatccatgtcgacactatagtcgtaatctttagctaacaaagaaatctcatcaatgggcatgccataggtatctttgagcttgaaagcatcttcacctgaaatgcaagaggaggaagaagaacttttcaaaacttgctgtagaaggtttcctccacggtcaagagttttaaagaaactttcttcttctaaagtgagtactttttgaatttgggatagcgaattctttaattcagggtaggcctctcccatagcatctgctaatgagggaacaatttctgctaagaagggattgcgaaaccctaaacgccgtccatagtttacggatcgtctcaaaatttttcttagaacatagcctcgctcagtgtttcctggaaggagaccatcagcgatagcaaaagataaagaacgtacatgatccgcaattacccggaaagctgcaccactatcatcgggatgatagactttcccagagagctgctcagtctttgcaatcagctcgcgcaacacatccgcttcaaaaacagtgtgcgtcccagcaattaaagagacaagtctctctagaccagctcctgtatccacatgtttattaggtaaagcaagtaaagagccttcgctggtacgattgaattccatgaagactaaattccaatattctaagaaacgctctccatcagtatcgtcaaggggagaagaggcgtttccaaaactggggccacgatcaaagaggagctcggaacaatagccacaggggcctgtgtttgccatgctccagaagttgtctttgtctgtaagacggaaaatacgatctgtaggaagatatgcttcccaaagagcaaatgcttcatcgtctttttcatgtacggtagcgtaaatcccttcgggattaaaattaaaaacagataaagagacttcccaagcaaaggcaatcgcctctgctttaaagtagtctccgaaagaaaaattccctaacatctcgaagaaggtgaggtgccttgaagtatgacccacattatctaggtcgttgtgtttccctccagctcgaatacatttctgcgatgttgtggctcgagagtagctcaccttctctttatttaggaaaatatccttaaactgattcattcctgcattcgtaaaaaggatcgagggatcattgtgaggaaatactggagaagagggaagaatggtatggtggcggttagcatagaattttaaaaaattggagcgaatagtattgcttaacatgaaaaagaactctcaacggcagcggttttgcagattccttgccattataggagagttctttattttcgtctctatccctaatttttagttaaaaaactttcctgtttattattgagatttgatcgaaaattcatttgtttttgaaagaattacaaggtaagagttccttgctttttgcttggggatttcctatagttgctgcttttacatagaaggtctccagggtttacttatgatcaataaagaattagatattggtattttaggaaaaattgctggggctattaaacaaattagtattgaatccatccaaaaggcctcttctggtcatccaggacttcccctaggatgcgcagaacttgctgcctatttatatggttatgtcctgcggcaaaatccacgtgatccccattggattaatagggatcggtttgtcttgtcagcaggtcatggatctgctcttctctattcttgtttgcatcttgccggatttgatgtttccttagaggatcttcaggaatttcgccagcttcactcccgaactcccgggcatcccgagtacggcgaaactgtgggagtcgaagcaacgacaggtcctctgggacagggattaggcaatgctgtcggcatggcgctctctatgaagatgttggaatcccgattcaatcgcccaggacatgagatttttaacggaaaaatctattgtttggcaggggatggctgttttatggagggagtcagccacgaagtttgtagctttgcaggctctttaaatttaaataatcttgtggtcatctatgactacaataatgttgttctcgatggatatcttaatgaaattagtgttgaggatacaaaaaaacgttttgaagcctatggctgggatgtatatgaaattgatgggtatgattttacccatattcatgagacattctcgagcatcaaacgggggcaggaacgtcctgtattagtgattgcacatacaattattggtcatggttcgcctaaggaagggacaaataaggctcatggttctcctttaggagtcgaagggactcatgaaacaaaacagttttggcatctccctgaagaaaagttttttgtccctcctgcagtaaagaacttctttgctcataaaatacaagaagatcgaaaagcacaggagcaatggctggatgaagttcgtgtttggtcaaaacagttcccagaattacacgaagaattcgttgcgttgacctctcataagttacctaaaaacttagaatccttggtgcagagtgtagaaatgccagactctatagctggccgggctgcttcaaataaactgatccaagtattagtacagcacattccttatttgattggagggtccgcagatctttcaagctcagatggaacttggattgcgaatgagaaagtcatccatacgtatgacttctctggaaggaacattaaatacggcgttcgtgagtttggtatggccacaatcatgaatggtttagcttatagccaggtatttcgtccttttggtggaacatttttagttttttctgactatatgcgtaatgcaattcgcttggccgcattatctaaattaccagtcatctatcaatttacccatgattctatatttgttggagaagatggacctacgcatcagcctgtggaacaattgatgtctttgcgcgcgatccctggattgtatgtaatacgtcctgccgatgctaatgaagttagaggagcgtggattgcaggattaaagcacacaggtcctacagtcattgtcttgtcgcgacaagcattgcccacactgcctgctgcgcatcggccttttaaagatggtataggtcgtggtgcttatattgtcttaaaagagtcaggagaaaaaccagactatactctcttcgctacagggtcagaagtttctttagctctttctgtagctaaagaactcgaacacttggataagcaagtgcgtgtagtttctttcccttgttgggagctttttgaagctcaagatgtggactacaaacagagtattgtaggcggagatcttggaattcgtgtctctatagaagcaggatctgctttggggtggtataagtatatcggatctgaaggtttagctatcgctatggatagattcggatactcaggagcttctgatgatgtatcagaagaatgtggctttactacagagcaaatccttcagaggattctctctcaatagtcactgtcggaagtttcagagccgctagccatagtgtcatcggcttctccaacttccatatgaggtaatcctcgatactgttgatccttcttatggtcagaagctgctcgttttagcatgactttttcaaggttctctatgacttcttgtcctgttaagatgtggtcttccgtataagtattaaagatgaagttcccactggacttcgttttgattccctccttccttaagggaagatctgaaatcaataataacgctccaatgggcaggtttctacggtatccggcagcaaaaagtgtcgcacactccatttcagcggattgagctttggtttcgtacagtttttttctaaattttttgttaaattcccaaaagcgaatgttggtcgtgtgggtaatgccaatatggtagtttgccttcttatcttctaaaacttcagttgttgctttctgtacaacaaaatttgcaagagccggaacttcaggagggaaataggcgtctgaagtaccctctccacgtatgctagctacggggacaaagtaatctccaacctgataatgagagcgtaagcccccacacattcctaacataagcgctgctttgagatcaggaagaaatgaacataagtctatagttaatgcagctcctggagaccctagtttaaaatctaaaattgaagttttaagatgaggagcatgggcagcagaaaacatagaaccctcaaagacgggcaccccatgaagttttgcaaaggtttggatatagtaagagaagttcgtgagtaagagataaggacaaaattgctttacgctagagccagaataacgttctaacatatcttgagcaatcctggattcagaagtatgtttggacacacgctctcctttgtaatgttttcttctcagattcttagcattcttatcgtttctcggtcattaaaaaaatcctagaaatcaaaagatagaattctgataagggacagctgcaatcatttacatagaaggagagtccttcgattcctgatgtacattcttctggacaaaggagaaaaagctcgataacataaatcgaagaaaattaagaaatagattgctttatggttcgtgtaagtactagtgaattccgtgtgggattaagaatagaaattgatggtcagccctacttgattttacaaaatgattttgtaaagccaggaaaaggccaggcttttaatagaatcaaagtaaaaaattttttaactggcagagtcattgaacgaacctataagtctggagaatctgtagagactgcagatatcgtagagcgctccatgcgccttctgtatactgaccaagaaggggccacgtttatggatgacgagacctttgagcaggaggttgtcttctgggagaaactcgagaatattagacagtggttattagaagataccatctacaccctagttttatataacggggatgtggttgctgtagagcctcctatttttatggagcttagcattgcagaaacagctccaggagtgcgtggagatacagcatcagggcgtgttttgaagccagccgtgacgaatacaggagctaagatcatggtccctatctttattgatgaaggggaattggtcaaagtagatactcgtacgggaagctacgaatcccgagtttctaaatagattgccgttgtaggaaaagtatttcttttttacagtgcgtaatatggaagctaagaaaatcaaagagctatctaaagaagctcaattgctaaaaaaattaagagagaagtctcgggttcttgatgaaaagaacaagcgcaaagcttgggttgctaagcttgtagctatgccagagtctatccgagagatagagaaagaagagcgcgtagaaactcctcaattatttcaagctatagcagagaagattttagaagaaggtgtttagtcacctgaatcttcctgcatcattctataacttctgacagtcccaagttgcttcattagcaatttctaaaggtgcatcaaagtctaagagatttttcaaaatcatagtgtgcacctgatatttttcaggatacaagtctataacatggaaacgtgaattcgttggtagagagatcgacccgctattgagaatataagagggcgaagtgtccgcacaattgtaaacagcagcttggtgttcgtgaccgtgtagataaaggcgtactttgggatatttcttcaaaacgttttgaagatgtgtattgttgataagatcatgactgggattttgtgaagagagcagaggataatggtttgcaatgatgacattctcttcaggggaaagagagagcaaaaaggtttcaatagccgaaatctgtgctaaatgcaccactccatttgctgaaaaccatccattcaaacaagaacaatctaataaaattaaccaccaatgatcagtgatcttgtgaaaggacaccttattctgttggagctggtcatttgggaagtgggtgtaaaacgtttgttgtgcaagagatttcagggtgtagacatcgtggttgccaggcaaaaggtaaaccgaggaatgcttagcgagagtttcaacgaaatgcttagcgagtaagaactctccatccatagccgtgagggagaaatctcccgtgatgcacacgctatccgctccaagagatcggactaccttagggaaacgctgccctatagttgtagcttgaaaatggactaacccaaataccttgcgcagaagtcctttgagccttttattaaagcagtgcacgggattgacagggagaacatgaaaatgtacatcggaaatgtgaataatacgatgcacatgtcggggcttttcttgcataggacgtgggttacttttgtttttctgatctactgtattagaatctagggaaaaattctaacaacaaagatcgatctctaaggagaagcccttagagtcaagattctaaggggctatcccaaatgattgataccaaggggtttattaattttataagagaagatcagagcgtagaaatctcatattgattttctaaaattaaaattttagaagagagaacgagaatcgctgtatctaaggcttgggctaggattgtagatgtcgtagctaacgaatctaagattccaccagcaataagatcttcaatttctctagaaaacacactgattcctaggcttgttgttccaagtgaggagagcttagcaatcacggcatccccatccaagtctgcattggttgccaagagcttcagaggagcacaacaggccttctgtaagagagaaattgcaatactattctcatcagcatcatctttaggagtccctaaagttaaagatgcatagaacaatgcaacgcctcctccaggaacatacccacgacttaaagcagattccataatcttaagagcgagggtatataaaggttcgttatcttcatcagtaggaagaatggctaccgaactttggagcctatttgtgcttttgattagccttttttttgtttcaaggcatgaggtcgtgcgtatttcttctgctaattgtcgcgtctttaaggtcaggacttccgggatatgtaggcctccaatgagtgtcgtttgtgactctgagatttctatagatagacaggaccctaaagtgaccatctcaggagctaaaacatgagatgcttcttggcaaggacaaatgtgggtcccagtaaataaagcaatatcctcggctaattcttgatttgtagtagagagttgaggaatggtgactacagttacttgcaagagcccttgcaatttgttaacaacaagggtagcaagtacgtctggatcgatatcttcacagaaaatgatgaggtgctggttttgttctgaaatttcttggagtaggggaagtaaggagtgaatcatagagatctttctatctgtgatcagaattagaggatgagcaattctagttagacgagacgctgtatcagaaacaaaatacgtcgaagcataccctgcaggaattttaaatccttgaaagacatccatggaagttttgtcgttttctctctccttagtgatggagataagaccctcagggcctaccacagaaaaagcattgtaaaaatgatcggcaatggtgggcatgtgtagagaagaaaaaataatattgcgaacttttagagcatctttaataggccaagattgttgttgtaaggcttcctgaagcttttctccctgcaattttaaagaggcaatgagcttgtgtgtggagattcccttttctaaagctgcatagctttcctgtaaaattgcatggagtaaaataagtccagtagtcgcgccgtcgctgtgttccttatgaattttattcaccatagctttcgcaaaatctacaccgagattttcataggaattcgaaagttctgtttgtgaaatagcgtagaagccacgctctttaaagaaagaagttggggagagggattgcttgggaccatacgatccctttactatctggaaaagtttatctatccctgaaaaaagttttttatcagcattgtaattagataatttttcctgttcggacatgcaaacccccagtagacgtaaaatttttacactaccaagtcgttttttagttcacaataccttcagtaggaaaggtggcacccggaatcgaaccggggatagaggctttgcaggcctcggccttaccgcttggctatgccaccaaaggggaggatgagaatccttagtttaagcgaaagaagattttatggtaagcgagaagtgcgcataattctagagactagggaaatcttagtcgtttttgagagatgcaattgcattttagttctcttaaaaaagaggttatgtaatcaacctaataagggtacttgcattcttgtctgcattttaaatatagtactttttagtgtaggtccatccttctggtagggagttcagactttctaaaaccatagatgctgtaggcaaaattatatgcgagctatgttgcttgaagattgggtctctctgatgctatcagatgtctcttgtccgaagtgtgataaaaaaattacaggatttgctatagatagccagcaagtgcagcctggggatctattttttgcccttcctggaaatgcaacagacggtcatcaatttttaaaacatgccgcaaccgcaggagctgttgccgccgtggtttcccatgactaccaaggagatagctttggtctagaattgatccgtgttgatgatacgaaatctgctttgcaagaagcaggatccaatcaatgcaatttattccaaggcacccttgttggaatcacaggatctgtagggaaaacaacaaccaaagaattctcaaaaacaatcctaagctccatctataaaactcacgcaagccctaaaagttataattcacagttgacggtacctttaagcctcttgatggcggaaggggacgaagatgtgatgattttagagatgggggtctctgaaccaggaaatatgcaagatctccttcggatcgtccagccagagatcgcagtgatcacgcatattaatgaccaacatgcgatgcatttcccccaaggcatccaagagatcctaaaagaaaaaagctatattctacaaaaaagtaaactacaactgctccccaaagattctccatattacctagatttaaggtcctgttctcctactgccgaaaaattttctttttcttttaacgatccccttgcagatttctgctacaaggcaattagtggagactctgtagtcatccaaactcctgaagaaaattattgtcttccgatagctttttcttacaagcctgcatataccaacttattaattgctgtagcactctcttggatcttagaagttccagaagagggagtgatacgctctctacctgaactgaagttgcctcctatgcgctttgaacatagcatgagaaatggaatgcaggtcatcaacgatgcatacaatgcatgtccagaagctatgatcgctgctctcgatgctctacctttaccaagtgatggagggaaaatcatcttaattttaggccatatggctgaattaggcaggtattcagaagaaggacatgctttagtagctgaaaaagcagcttctcgaggagatatgatattttttattggggaaaagtggatcccagttcaaagtgttttaaaaagctattcttgtgaagtgagctttttctcctcagctcaagatgttaaagacattttgaagcaagtggcacgctatggggacgtgattctactgaaaggttctcgtgccctcgctctcgaatccttattagcttgtttttaatttcttaggagcaagtatgatccccttaattccaatgtttctaaaacagtctctatttttttctttggctttgacagggatgaccacccttgtgcttacagtagctctgggtgttcctgtaatgaaatggctgaaaagaaaaaattatcgtgattacatccacaaagaatactgtgagaaacttgaaatgcttcacaaagataaagccgaggttcctacgggaggaggagtcttactttttatctcgttaattgcttctttacttgtttggttgccttggggaaaattttcaacatggttctttattatactcctgacatgttatgcaggtctgggttggtatgatgatagaataaaaattaaacggaaacagggacatggactgaaggcaaagcataagttcatggtccaaattgccattgcagcttttacactcattgctcttccttacatttacggaagtaccgaacccttatggactctcaagatcccttttatggaagggatgctttctcttcccttttggctaggaaaagtcttttgcttaggactcgctcttgtcgctattatagggacaagcaatgcagtaaatcttaccgatggtttggatggacttgctgcaggaaccatgtcctttgctgctctgggctttattttcgtagctctaagaagttctacaattcctatagctcaagatgtggcttatgttttagctgctcttgtaggggcttgtatcggattcttatggtataatggtttcccggcccagctcttcatgggagataccgggtcactacttctagggggcctgctagggagctgcgctgttatgctgcgcgcagaatgcatcctagtcgtgatcggaggagtttttgttgctgaagcgggatctgtcattctacaagtacttagttgtagattaaggaaaaaacgccttttcttatgctctccattgcatcaccattatgaatatcagggcctcccagagactaaaatcgtcatgcgcttttggatctttagttttgtatgcgcaggtctaggtatagcggctgtcttatggagatagatatgtgtcagcgcattcttattttagggactggaatcacaggaaagtcggtagcaaggtttttatatcagcaaggacactatctcataggagcagacaattctttagaatctctgatatcggtagaccatttgcatgataggctactcatgggagctagcgagtttcctgagaatatcgaccttgtgatccgctctccaggaatcaaaccgtatcatccgtgggtagaacaagcagtatctcttaagattcctgtcgttactgatatccaagttgctttgaaaacaccagaatttcaaagatatccctcctttggcatcacagggtctaatggcaagacaacaacgacattatttcttacccatctcttaaatactttagggatccctgctatagctatgggcaatatcggcttgcctatactagaccacatgggacaaccaggagttcgtgttgtagaaatcagctcatttcagctagcaacccaagaggaacatatcccagcactttctggatctgtgtttttgaacttttctcgtaaccacctggactatcatcgcaacttagatgcctattttgatgctaaacttcgcatccaaaaatgcttgcgtcaggacaaaacattttgggtgtgggaggagtgttccttggggaattcttatcaaatttactctgaagaaattgaggagattttagataaaggggatgcattaaaaccaatatacttgcatgatagggataactattgcgcagcttatgctttggctaatgaagttggttgggtctctccagaaggttttctgaaggcaattcggacatttgaaaaacctgcccatagactagagtaccttgggaaaaaagatggcgtgcactatattaatgatagcaaagccacaaccgtgacagcagtagaaaaggctcttatggctgtagggaaagatgttattgttattttgggtggcaaagataaaggtggagatttccctgccttagcttctgtattgtcccagacaaccaaacatgtcattgctatgggtgagtgtcgacagacaatagcagatgccttatcagaaaagattcctttgacgctctctaaagatttacaagaagcggtgtccatagctcaaactatagcacaagagggagatactgtgttattgtctccaggatgcgcaagctttgatcagtttcaaagttttaaagaacgcggagcttactttaagctgttgatcagagaaatgcaggcagtgaggtaaatatgaatcgtagagacatggtaataacagctgtcgtagtgaatgctatattgcttgtggctcttttcgtcacatcaaagcgtattggcgtcaaggactatgacgagggattccgtaattttgcttctagcaaggttacacaagcagtagtttcagaagaaaaagtcatagaaaagcctgtagtcgcagaagtgcctagccgtcctatcgctaaagagactctagctgcacagtttattgaaagtaagccggttattgtaaccacaccacccgtgcctgttgttagcgaaaccccagaagtgcctactgtggcagttccgcctcagcctgttcgtgagacagtaaaagaggaacaagctccttatgctactgttgtagtgaaaaaaggagattttctcgaacgcattgcgagagcaaatcatactaccgttgcaaaattgatgcagatcaatgatcttaccaccacccaacttaaaattggtcaggtcatcaaagtccctacgtctcaagatgtcagcaacgaaaaaactcctcaaacacagaccgcaaaccctgaaaattattatatcgtccaagaaggggatagcccgtggacaatagcattgcgtaaccatattcgattggatgatttgctaaaaatgaatgatctcgatgaatataaagcccggcgccttaagcctggagatcagttgcgcatacgttgatctaagcagtcccttagcatgaaatggtttgttatttcctgtttattaggaatcttttctctagggctgattatggtttttgatacttcttcagcagaagtattagaccgctctttagaatgtagtacacataaagctctcatccgccaggtgacctatcttatccttggcttgggagtcgcatcgcttctctacatgatggaatggagagatttcttaaaaatcagtcctgtgttgctttcaggagctgccctagccttaatctgtgtgtttattccaggattagggatatgccgtaatggggcaagacgttggttggggttcggtcagctaacgattcaaccttcggaatttgtcaagtacctcgtccctatagtcgctctatatttccttacattctcttccctctatcagaaacaactgaaaatgtttcttaaacttacagcaattttatttattccgattcttttgattgctatagaacccgataacggatctgctgctgtaatttcagcatccctgattcctgtgtttatcatgacctcagtgcgcctccgctactggcttctaccacttctgtgcgtcctcatagctggaggagcccttgcttatagaatgccctatgttcgctaccgcttaaacgtctaccttcatcctgaactcgacatcaaaggaagaggacatcagccgtatcaagccaaaattgccgcaggatctggaaagctactaggaaaaggtcctggagctagccttcagaagcttacctacctcccagaagcccaaaatgactatattgccgcaatctacgctgaggagttcggatttttaggtatgctcgtcctcatacttttgtatatgtgctttgtttacggagggtatgcaatcgctataaaagcatcatcactagaaggtgctgctttggcaatggtcattactttgattattagcatgcaagcatttatgaatttaggagtcgtttcaggcctgcttcctagtaaaggagtcaaccttcctttttttagccaaggagggtcctctcttatcgcaaatatgtgtggagtcacgttgttattgaaggtatatgatgaagaaaattcgaaaagtagccttggctgtaggaggttcaggaggccacattgtcccagctctctcggtaaaggaagctttttctcgtgaaggaatagacgtattactactagggaaaggtctcaagaaccatccttctttgcaacagggaatcagctatcgggaaatcccctcaggacttcctacagtccttaatcccataaagatcatgagcaggaccctttctctatgttcaggatacctgaaagcaagaaaggaacttaaaatttttgaccctgacctggtcataggatttgggagctaccactctcttcccgtgttgctcgcaggactgtcccataaaattcccttatttctacacgaacaaaatctagttcctggaaaagtaaatcaattgttttcccgctatgctcgaggtattggagtgaatttctcccccgttactaaacacttccgctgccccgcagaagaggtcttccttcctaaacgaagcttctccttaggaagccctatgatgaagcgatgtacaaatcatacccctacaatctgtgttgttggaggttctcagggagcacagatattaaatacttgtgttccccaagctcttgtcaagctagtcaataagtacccaaatatgtacgtccatcatattgtaggacctaaaagtgatgttatgaaggtgcaacatgtttacaatcgtggagaggtcctctgctgtgtgaagccgttcgaagagcaactcctagatgtcttgcttgccgcagatttggtcatcagtagggcaggagccacaattttagaagaaattctttgggcaaaagttcccggaattttaattccctatccaggagcttatggacatcaggaagttaatgctaaattctttgtagacgtcttagaagggggaactatgatcctagaaaaagaattaacagagaagctattagtagaaaaagtaacgtttgctttagactcccataacagagaaaaacaacgcaattccctagcggcgtatagtcagcaaaggtcaacaaaaacattccatgcattcatttgtgaatgcttataggttcattatatgaagggaactcctcagtatcattttatcggtatcggtggtataggaatgagcgctttagctcatattttgcttgatcgtggctatgaggtctctggaagcgacttatatgaaagctatacgatcgaaagcctgaaagctaaaggtgcgaggtgtttctcaggccatgattcctcccatgttcctcatgatgccgtcgttgtttatagctcaagtatagcccctgataatgtagagtatcttaccgctattcaaagatcatcacgtcttcttcatagagcagagctcttgagtcagcttatggagggttatgaaagcattctggtttcaggaagccatgggaagacagggacctcatctctaattcgagcgattttccaggaagctcagaaagatccctcctatgctattggaggactcgctgcaaactgcctgaatgggtattctggatcatcgaaaatcttcgttgccgaagccgatgaaagtgatgggtctttaaagcactacactccccgtgcagtagtcattacaaatatagataatgaacatttgaataattacgctgggaatcttgataacctggttcaggtaatccaggacttctctagaaaagtaacagatctcaataaggtattctataacggggattgtcctattttgaaaggaaatgtccaagggatttcttatggatattcaccagaatgtcaattgcatatcgtttcctataatcaaaaggcatggcaatctcacttttcctttacctttttaggccaggagtatcaagacattgagctcaatctccctggacaacataacgctgcaaatgcagcagcagcctgtggagttgctcttacctttggcatagacataaacatcattcgaaaagctctcaaaaaattctcgggagttcatcgacgtctagaaagaaaaaatatatccgaaagctttcttttcttagaagattatgctcatcatcctgtagaggttgcacataccctgcgctctgtgcgtgatgctgtgggtttgcgaagagtcatcgcaatttttcaaccacatcgattctctcgtttagaagagtgcttacaaaccttccccaaagctttccaagaagctgatgaagtcatacttacagatgtctatagtgccggagaaagtcctagagagtctatcattctttccgaccttgcggaacagattcgtaagtcttcttatgtccattgttgttatgttccccatggagacatcgtagattatctacgaaactacattcgcattcatgatgtctgtgtttctctaggagctggaaatatctatactattggagaggctttaaaagactttaaccctaaaaaattatccataggactcgtctgtggagggaaatcttgcgaacacgatatttctctactttctgctcaacatgtctctaaatatatttctcctgaattctatgatgtgagttacttcatcataaatcgtcagggcttatggagaacaggaaaggattttcctcatcttattgaagagactcaaggggattcgccactttcttctgaaatcgcttcagctttagcaaaagtcgactgtttgtttcccgtgctccatggcccatttggagaggatggtacgatccagggattttttgaaatcttaggaaaaccttatgccggaccctcactatctttagcagcaactgcaatggataagctgttaacaaaacgaattgcatcagcagtgggtgttcctgtagtcccttaccaacctttaaatctctgtttctggaaacgcaatccagaactatgtattcagaatcttatagagacattttctttccctatgattgtaaaaactgcacatttgggatctagtattgggatatttttagtccgtgataaagaggaattacaagaaaagatctcagaagcatttctatatgacacggatgtgtttgtggaggaaagtcgcttagggtctcgtgaaatcgaagtgtcctgtatcggccattcttctagctggtattgtatggcagggcctaatgaacgctgtggtgctagtgggtttattgattatcaagagaaatatggatttgatggcatagattgcgcaaagatctcttttgatttacagctctcacaagaatctttagattgtgttagagaacttgcagagcgtgtctaccgagcaatgcaaggaaaaggttcagctcgaatagattttttcttggatgaagaggggaattattggttgtcagaggtcaatcctattccaggaatgacagcagctagcccatttttacaagcttttgttcacgcaggatggacgcaagaacaaattgtagatcactttattatagatgctctacataagtttgataagcagcagactatcgaacaggcattcactaaagaacaagatttagttaaaagataataaaaaaactagagatctttttattaaaatctctagtttttacatgtaaacaaaagcagacgaataactacgattaatggtggttactacattcgcaagaatgatgcatattgccttcttcttgttcttcttgattaagatcttcgtcgtaatgacagtgtccactgcagcaggtgtcagactcgccgaaagtatcttcagtagagttagaagagtcattatcacagatgtaatcttgatcagcaatcacatcagttccattttcaggctgaaccaaatctatctgcactttcttttttaatctagaacatacacgtctaagaatcgttcttagcgcatgtattgtgttccctcttcttccaataattttcccaatatcctctgctgcgacacgaatttctaacttaatagattcgttatcctcgtcttcaatagaacgaatttcaacagcttcaggattagtaactaaattcttaacaatatatgctacaaactcttccataaagtccaaattaaattgagatatagaaagaaaaaaacataactctatgtttttaaagttcctgaagaaaggatagatattcaaaatgaaaaagtcaatgtctaatctgaaagcggaggcttctctggatagctgagaatcgttaaccaattcaagtacctcggatccccattttcaataggaaatagtaagacttcaggaacctcatagccagagaactcctgaatagcaagacaaatttccgagaagcgtatgtctatcgatttgatttgtatatgatgttcttcagactcacatagcttgccttcccatagatatgtcgatgtgcctttagggaatacatgcacacaggaagcaagacgctctgtaatcagatgtctagctaaggagcgagcactttcctccgaagggaaagatgtaagaataagaacagcagtcatagagcttttaataataagaaatttggaaaacgcaaatcatagacatattgtttttcgctctcgattacaggactttttttcatgtgcttatacaggtctaaggcacgatctaaggtcttaattggaagtcttaacagactgcctgaagagagcgtcactataatttctccagggtatgcatcagataaagataaatcaatgattttcggagactccatagcaagctccttaagaagaatcttggtaaaaagcattttttctttagggagtttttgcatttttaaatcttcttgagagaaaaaaatctgagggagattcagagaggggaagtacggttgaccaagaaagcagctcccctcgagattgcataacgtattagatcggttcccaacataagcaataggtgtttgtaaggtatagaaaattgtaatgcccttattatcaggagatttttctataactaaagaggaaaaaatcccaagagcatgcaagctcgactcagcttctttaatagagaattcatggagatatgtaggtgcatccgcagaaagacgtaaatgttctgcaatcgcagtaggagggactttggatagagtggaggaaactaaaaataggttcctaatgggagaaggattgaatttagataaagacagttcagggagaaataaccaacaaaatgtaggaacacaaacaagggaactcaaaacgatcaggatcgaagcataacataaagagtattgaggacccggagggaaaagcgttttgaaaaaacgtcttatcatgagctcattgttttttattatgatcataaataatatcgctaatatttacgagattcctcttggagagattactgatgaatttatcagctaaagaatacggagatatcattgttatttatttacaaggatctttagatgccgtctcagtgcctagtgttcaagagtatttagagcagtttatacagaagaaacatcttaaaattgctctgaattttacagatgtctcgtatatcagtagcgcagggattcgtctactgctgtctaattttaaattggttcagagcttgggaggaaaaatgtgcctatgctgtgtcaaagagagtgtaaccgaagtcatgcggattgcaggtttagaccaattgatcttgctctgccagtctgaacaggaatgtttaagtaagttatagtttctctatatgcttccttttgaattcgagtttaatacaacttcttctcctgaatgcgacgtatgccttgatcctcagaagttatttgtaaagctatttaagcgtacgatcgtcttgctttcaggacctacaggatctgggaaaactgatgtttctttagcattagcccccatgattgatggagagatcgtctcagtggattctatgcaagtataccaaggcatggatatcggaactgcaaaagtatctctaaaagctagacaagagattcctcaccatttaattgacatccgacatgttcaagagccgtttaatgttgtggatttttattatgaagcaattcaagcatgccaaaacattttatcaagaaataaagttcctattttagttggtggctcagggttttattttcatgcctttctttcaggtcctcctaaaggtcccgcggcagatcctcagatacgagaacagcttgaagcgatagcagaagaacacggggtttctgctctttatgaggacctacttcttaaagatccagaatatgctcaaacaatcactaagaatgataaaaataaaatcattcgaggattggaaattatccaacttacaggaaaaaaagttagcgatcatgaatgggatatcgttcccaaagcttcaagagagtattgttgtcgtgcctggtttctttcccctgaaacagaatttttgaaaaataatattcaaatgcgttgcgaagctatgctgcaagaagggctgctagaggaagtcaggggattattgaaccagggaataagggaaaacccttcagcattcaaggccattggatatcgagaatggatagaattccttgataacggagagaaattagaagagtacgaggaaacaaaaagaaaatttgtatccaatagttggcattatactaaaaaacaaaaaacatggtttaaacgttattcgatatttcgagaacttccgacattaggcctctcttcggacgcaattgctcagaagatagctaaagactacttactgtacagctgatgtgttgataaaaggtatttctctccacaggaatgaaaccttcagatcgaatgatattacagatttcttcttcagagctctgtatcgaccatcctgtagctttatgcacgctttcgtctaaaataacccctccaaaatcatcagctccgtaatggagagctttcgctcctaagcttttaccctcgccaaaccatgaggctgctacgtgatcaaaattatccagaaagattctgcccaaagctaaaatgcggtaataggtttcaatagaagcttgttgaggaacgttacgtcttagggccgtattcccaggtttataactccaggggataaaactataaaagccagggcagctatcttgagcatcacggagtgtttgaagatgtataaggatatcttctgggttctccacatgcccaaacatcattgttgctgttgtgcgaaagcccatgagatgggctaacttatgtagattgatccagcccccaggctgcattttttttggagagatgatttttctaactctctctgaaagaatctcagccccgcccccagggatggtacgttgccccgcatcccataacctttggagaccttgctcaatactgatgccagagacccggcaagcatgttcgatttctactgcagaaaagaaatgaggatggatggaaggaaattcttgaacagtaatgcgtacgagttcttcaagataatcgatgcctaaccccgggtgcacaccaccttgcagtaaaacagttttgactcctgaacttacataacgttgtaataggctgcgaacttcatcaaaagataatagataagcgtcgggagatttaggctttctgtagaacgcacaaaacgtacaatctattttacaaatattagtatagtttggattggcatccaaaacataagtaacttcatttgaaggatatcgttctttacgaatcgcgtccgcacgctcttgtaatctctcgataggggacgaaacaaatagctctaatccttcttcaaatgaaattcttttacataaattcataaaataattgacgttaaagattgctagcagcagactttaagttttaacaattttatttgtcaagccccacacctaagttgttattatggataattcagacaacagctttcatactttggaaacggagcagggatcgtttttaaacgatgaattagcagtcgaagaagtggcgtctacagaaagcacagaaatttctgatgcgacattatgtttcgctgaaaagaaagttgcttttatcttgaataagatgagggaagccttaacaggatcatctcaaggctcagacttaaggttgttttgggatttaaggaagcaatgcctccccttatttaatgaaatcgaagataccgcgaaacgggcagatcattggcgttgttatatcgagttgactaaggaaggccgtcatctcaagggtcttcaggatgaagaagggtcttttgtcgttggtcagattgatttggcaatcacatgtctagaaaaagatattcttaagttccaagaaggaacagaagataaaattttcaaagatagagaagataatttcttagaaagccaagctctagataaacatcaggctttttataagcagcatcatacctcattgctatggttaagtagtttttcttcaaaaatcatagatctccgcaaggaactgataaatgttgggatgcggatgcggttgaagagtaaattttttcaacgtctctctaatttaggaaatcaggtgtttcctaaacgaaaggaactgatcgaaaaagtaagtcaaacatttgcagaagatgttgatgcatttgtcgctaaatattttattggatccgataaagaaacattgaaaaaaacggttttttttttaagaaaagaaatcaaaaaccttcaacacgcagcaaaaagactttttgtctcatcgcatgtttttgctgaaacacgattgaaactcagtaagtgctgggatcagctcaaggggatggaaaaagaaattcgccaagagcaaggccgcttacgtgttgtatctgctgaaaattcaaaagaagttcgccagatgttagctgaggtctcttctcttcttattgagggaaatgatctgagtaaagttcgtaaagacttggagggcatttctaagaaaattcgagctcttgatcttacgcacgatgatgtcatctctttgaaaaaagaaatgcaacaattatttgatcaattacgagagaaacaagacgcggcagagcattcctatcaagagcaattagctaaagataaacaagtcaagaaagaagcggctcgctctcttgctgagcgcatcacaacattctcaaaaacttgctccgaagggaacattacttccgaatctcgagaagaatggcagacattgaaagagctcttaggtaaaatgtcttttttacctcctcctgaaaaaatttctttagataatcaactcaatcttgctcttcaaactattgttaacttctttgaagaacaacttctctcttctccagattctcgagaaaagcttgtgaatatgcgccaagtattgaagcaaagacgagagcgtcgtcaagaacttaaagataaattagagcaggacaaaaaattattagggtcttcaggattagattttgatcgggccatgcagtatagtgctctagttgaagaagacaagcgtgctcttgaagaattggatgcaagtattttagaattgaagcaacagattcagcaattgctatgagaagaaactgtatatatgcttttgatttagacggaaccttattgaaggggaatagcagctggagtttttattgctacggcttacttcaaggtttgttttcctataaaacgttgcccccctgcatttaccgcttttttagatttaagtttttttttgggatcttccatccttctattattcgatagtaactcgtctactctcttctgttccctgtgatgatctttatgaagttgccttgaattttgtatcgactctgaccggctccgatttttatgctcctgttttagaaaaactagaagaagcttttgcagataccacaggacaggtgatccttttttcttcttctccagactttattgtccaccccatagcgcagcaactcgggattagttcttggtatgcgtcgtgttatcgcgatcagtctgcagaacagacgatctataaaaaatgtcttacaggggataaaaaagcgcaaattttgagttatattaaaaaaattaatcaagcaagaagccataccttctccgaccatattttagatcttccttttcttatgctgggagaagagaaaaccgtcgttcgccctcagggacgactcaagaaaatggcaaaaaaatattactggaatatcgtttaattccatttaaaaaaaagctcgaccttatcttggataatcgagtatcctaaagctggttttatggattcattttgttttgatctattgaaagtagctgctaaagctattgacgacaaaaaagggaataatctggttgttctagatgttagaacaatttcggaatttaccgattattttgtttttgttgaaggtagtgtgaatgtgcatgttaaggctttagcaaatactatcgtagaagagttaaaaaagcagaaagttagtcctcttcatgtggaggggataacggatggtaattgggtggtgatagattacggatttatcgtcgtccatgtatttgtctctgaaattcgtggaaaatatcgtttagaagagctatggaaggacggatttattgtcacatccaagcttttagcttcttaatggagtaagggtctacatgagtaaaaaacgcgtagttgttacaggattcggtgttgtatcttgcctcggtaatgaagtagataccttttacgataatcttcttgccggtgtcagcggcgtacggccaattacatcctttccttgtgaggattatgccactcgttttgccggctggatcccagaattcaatcccgagccttatgtagataaaaagcaagcacgtcgtgtcgacccctttattacctatgccatggtagctgctaagaaagcgatcgctatgtcacgttgggataaagaccatctgccttccgatcccgtgcgttgtggagtgattgtcggctctggaatgggtgggctctctaccctagaccaagggatggaaagactcttagttattcataaaaaattatctcccttctttattccttatatcattacaaatatggccccagcacttattgctatggactttggtttgatgggccccaattattctatatcaactgcatgtgctacaggaaattattgtattgatgccgcctaccaacatttagtatctgggcgcgctgatatgatcatctgtggtggtacggaagctgcagtgaaccgtattggtttagagggttttattgctaatcgtgctctctctgagagaaacgatgctccagatcaagcttcacgtccttgggatagagatcgtgatggctttgtcttaggagaaggagcaggaattcttgttttagaaaccctagagagtgctctacgtcgcgatgctcctatttttgctgagatgttaggaagctatgttacatgcgatgccttccatattaccgctcctagagatgacggtgaggggattactgcatgcgtgcttggtgctttaaattccgcaggaattcctaaagaacgtgtcaactatgtgaatgctcacggaacgtcgactccattaggggatctttctgaagttctagctgttaaaaaggcttttggctcccatgtacgaaatctccgcatgaactccactaaatcattgatagggcattgtcttggagctgctggaggtgttgaagccgtcgttgcaattcaagctatccttacgggaaagcttcatcctacgattaatttggataaccctatcgcagaaattgaagactttgatgtagttgcaaataaagctcaagactgggatattgatgtagcgatgtccaactcatttggttttggtggacataattcaacgatattattctcgaggtatgtaccctagttatgatgaagacaaaatatgagtattcttttggtgttattcctataaaattttttggcacccccgataagaacacattaaaagcttgttttatttgccatactcgaggaaaacattggggattccctaaagggcattctgaagataaggaaggtcctcaagaggctgcagagagagaattggtagaagaaaccggactaagtgttgttaatttcttccctaaagttcttatcgaacagtattcgtttaataatgaagaacaagtcttcgttcgcaaagaagtcacctattttcttgctgaagttcgtggtgacatccatgcagatcctatggaaatttgcgatagtcaatggttatctttgcaagaaggactccgcttattaagttttcctgagctacgagatcttaccgtagaagcagataaatttattaataactatcttttctcttcttgattttcaaggagagggaacccctctccttagacattaattcacttcagcagtgtctccaatataggataagtaatcctcgtgagcgagctgtatcaccttttgtgcttccttcttcccgtaaatccccacgatttcaatttttgcagggctacctttaattaaatgattgggagtcgctttatatgttaggaaatagtgttggatcatatctaatactgtgcctggacagtctgaaatatcttcgatctcagcaaagactaaatcgtcctctaaaacagcaataatcttatcatcagcttctccagaatcaatgatgcgaagacctcctataggacgtgcttgaagtaaaatatttccatgatggatatttttttctgtaagaacacagacatccagagggtctttatcaccttggattccttcgcgacgtgtttgttccccgctatagttcccagaagcagtgccacagtatgtttgaggcagtaaaccataaaggcagggacaaaagttagaaaatttttgaggtctgtctactttgagcaagcctgtagccttgtctaattcaaattttacagagtcataaggagtaatttctatataacaacacagggactcataattatcctgggttaatgtagggctgtgccaaggatgtgcaacatataatggttttttagacataagtaactctcaatataaaatttcctatacaatcgggtttagtgaatttagactaacacggagaaagttttaagagaagtgtctgctcaggcctaattgacttttaattaaaagtagtcaataattttattttctaattaaacctcactaatttatgaaatactcactgaactttaaagagatcaaaatagatgattatgagcgtgttattgaagtcacatgttcaaaagttcgtcttcatgcaattattgctattcatcaaacggcagtaggacccgccttaggtggagtgcgagcctctctatattcttcttttgaggatgcgtgcacagacgctcttcgcttggctcgggggatgacctacaaggcaatcattagtaatacaggaacaggcggggggaaaagtgttattattcttccccaggatgctccttccctcactgaagacatgctgagggcttttggccaggctgtgaatgctttagaggggacctacatctgtgctgaagatcttggtgtatctataaatgatatttctatcgttgctgaagaaactccttatgtgtgtgggatcgctgatgttagtggagatccttctatatacaccgcacatggcggatttttatgcataaaagaaaccgctaagtatctttggggatcttcctctcttagagggaaaaaaattgcgattcagggaataggctctgtaggacgacgtctattacaatcgttgttttttgaaggcgccgaactttatgttgctgatgttttagaaagagccgttcaggatgctgcaaggctctatggggctacgattgttcctacagaagagattcatgcattggaatgtgatattttctctccttgtgctcgtgggaacgtgattcgtaaagataatcttgcagatttaaattgtaaggcgattgtaggtgtcgcaaataaccaacttgaagatagctcagctggaatgatgctccacgaacggggaattctttatggtcccgactatttagtgaatgctgggggattgcttaatgtggccgcagcaatagaaggaagagtctatgctcctaaagaagtgcttcttaaagtagaagagcttcctatagttctaagtaagctatacaatcaaagtaaaactacaggaaaagaccttgtagctttatcagattccttcgtggaagacaagctcttggcctatacgtcatagagcaataagcttatccgtggggacaacattgagttggttttgtaacgctgctaatgttgtctcatgggtttcctggtctccagaagcaagaatcactgcgtgattatttaagaccaaactttcttttctatattctaaaggggctcctaaagcatccgtgactctacccccagcttcttcaacgaggaaggctccaggtacgtgatcccaagcacgagcgggagaatcaataaaagggtagcgaatgaaaaaatctacggcgccttcagcaactaaagcatacttatattggctttctacacgacgaggactcggagtgttggggagacccaggcttagcttacgtgttgcatgatgctgttgattcaatgcagctaacgaagcctcacagaattgttttgtttgttttctatcagcataaacaaagcgtctatctagattttgagaatgaacaatagaaagaccatgacctttagctgctgaatatagtttaaatgtctgattataggcagggcatgccatgaccgacaaaatcggtcgatactcataaattagtgatatagcaacggcaaaagcacgatgtctgataaaacctgcagtaccatcaatagggtcgacaagccaaaataaagaagtcggagatggaggagggaccagggtagaaattaagtcatctcttgagactgaagaagttaacaggcgtgtaaattttaagatttcagggattttttcgttgtcttgatcaggatatagagtttcttctccaataaaaggaatattgggaaaggcttttgcaagctgttgttttagataatattgactgccgtaatcagcagcggtgataaaagaaccatcggatttttcccaaaaaggaaccaaacggtgctcgcttcgatagtttagtagttgtgtagtgatttccgtaactacagactcaacgatgttctgatagttaggcaactcggagtgcatagaattttcctcaagtatctagataagaatgttagcaaaagttaggattatgttaaacttcgggagtagcactataatagatagcatagtgcttacaaaaaattctttttccctaagtaaggggaacttatgctaatcaagctatggcgagctacttatgaagggatgtatacatttcttgtgggtgcgttgctaaagttgcgctaccgtatgcaagttgaagggtgggacaccttaaacataaatcctaagcaggggtgtttgtttcttgccaatcacgttgcagaagtggaccctattatcttagaatatctattttggagtcgattccatgttcgtcccatggcggtcgagtatttgtttcatagtcgcgttgttcaatggtttttaaattctgtaagatccattcctatccctcaacttgttcccggtaaagagagtaagcgctctttagaacgtatgaacgtatgttatgaagaagcctcacgagctttaaatagaggggaaagcctccttctttatccttcaggaaggttatcgagaacagggaaagaggaaatcgttaatcagtattctgcttatgtgttattacatagagttatggaatgcaacgtggttttagtcagagtttcaggcttatgggggagtgcgttttcgcgctataagcagaactctacacctaagttaggccctgcgtttaaagaagcttttcgagctttactgcgtcgtgggattttttttatgcctaaaaggtttgtaaaaattactctatgtcaagtagatcatctttttttaaagcaatttccaacaaaacaagacctaaatacttttttggcttcttggtttaatcaaggagatgacaatttgcccatagaagttccttacgcataacgaggaagttacgacgtatgcacgatcaacggaataggggtcataacaaccataatttaaggttgcgacctggatctacattattggaagcttttttaatattatgttccgaacatgaagagggaattgcctgttttgacgaacatctaggctcactctcttatcgagaacttcgcaatgctataattgctgtagcaattaaggtctccaagttttctgaagatagagttggggtgatgatgcccgcatctataggagcattcattgcctattttggcattcttcttgcggggaagactcccgtaatgatgaactggagtcaaggactcagagagctacgtgcatgtacaaaaacagtagaggttcgacgtgttcttacttcacagcagttcatcaaacatttaactgaggtccaagggttcgtagaatatccctttgatcttatgtatatggaagatgtgcgtaaacgcctttcctggtgggagaagtgccggatagggttgtattctaaatgctccgtcccttggttgctcagaatctttggagtttcaggggttgagagcgatgatactgctgtcattttgtttacttctggaacagaaaaacttccaaaagcagtccctctaacccataagaatttaatggaaaatcaggaggcatgcctcaaatttttcgatcctaatacacaagatgtcatgttggcatttctccctccttttcatgcttatggattcaatagctgtggcttgtttcctttactgatgggcgttcatgtagtattcgcttcgaatcctctaaaccctaaaaagttagttgagtttatcgatgataaaaaggtcaccttctttgggagcactccggtatttttcgactatattctgaaaacagcaaaaaaacaaaattcctgtttggagtccctacgacttgttgtgatcggcggggatgcattgaaagataccctctacgaagaaactaagaaattacaaccacaaattgctctctatcagggctacggtgctaccgaatgttctcctgtaatttcgattactacgaaagaaagtcctaggaaatccgagtgtgtgggaatgccgatcgaagggatggatgtgctgattatttctaaagagactcatattcccgtatcctcgggagaacagggattgatcgttgttcgtgggaactctgtattttcaggatatcttgggaaccatgaacatcagagttttgtctccttaggtggggatcagtggtatttgactggagatttgggtcatataggtcctagcggggatctatttttagaaggtaggctaagccgatttgtaaaaatcggtggagaaatggtaagcctagaagctttagaaagtattttgcatgagcattttactgaaaatcaaaatgaagacgcaggttccctagtggtgtgtggtattcctggggataaggtaaggctgtgtttatttactactcttgctacaacaatacatgaagtaaatgatatcttaaaaagcgctgaaaccagtagcatagtgaagatatcgtatgtgcatcaggttgaaagcattcctatcttaggcattgggaaacctgattacgtttcattaaatgctctggctgtttcattatttgggtaagtagccgtttctctgggtaggttgatacatagtgagtttgcaaggagagtttcttgactaccagtgatgttatagattttgtaacaaatgattttctaggtttcgctcgttctcccacaatatactgtgaggtaagtaagcgtttccaaatacattgtcagcagtttcctcatgagaagctcgggatccgaggttctcggcttatggtagggccttcttcagttatcgacgatcttgagtctaaaatcgcaagctatcatggagctcctaatgctttcatagtcaatagtggctatatggcgaacctaggcttatgtcatcacgtatcacgatctacagatgtccttttgtgggatgaagaagtgcatatgtcagtagtgcacagcctatctgcaatctctgggcaacatcatacttttcatcataacaatctggaacacttagaatctctattacagtgttacaggataagctctaagggaagaatttttatctttgtctcttctgtatattcttttagggggactttagctcctcttgagcaaatcatagcactatcaaagaagtatcatgcccacttaattgtagatgaagctcatgctatgggaatttttggagacgatggtaaaggactgtgccatgccttaggttatgagaatttttatgctgtattggttacttacggaaaagctttagggacgatgggagcctctttattaacgtcatcagaagtgaagtacgatttaatgcaaaattctccgcccttgcgttattctacatctttatctcctcatactctaatttctataggcacggcgtatgattttctagcctctgaaggggaaatcgcacggaagcaagtctttaagttaaaagagcactttcatgagtgtttcgactctcatgctccaggatgtgtgcagcctatatttttaccacacacctgcttggaagaagcaatttctgttttagaaactacagggatccatgtaggcgttgttgcctttgctaagcatcctttcttacgtgtgaacttgcacgcttacaatactgtcgatgaagtgaacctgttggctcaagttatgaagccatacttagaaaaaagtagtcatagggtccacatcaatcatgaatttcacctttggcgagagctttgccagcattaaggcgtgatggagtttcttattcactggaatgacataagcactcttaattaaaaactgatagcggaacgtatccttgattttaaaatgaccgcaaggagtcactggcatcagtggattcgtgctttctagctgctcttttagaatgttatggactcggtgggcctcttcccaagtctgcttgggacatttccccatgaaaatacaacggataagacggataaatggaggatactcacagagttcgcgacctgtgatttcctgactataaaatgccgagtagtcctgacgcatagcactatgaattgtgggatggtcaggaagaaaggattggatgagaatttctccaggtaggtggctccgacccgacctacctgctacctgtgtaatgagctggaagacttgctctgaagctcggaaatcagggatatacaatccagaatctccatttagaatgaccgcgagtgtgactgcagagaaattcatgcctttggcaatcatctgggtgccgatcaaaacatctgcttttcctgttgcaaattgcctgagtaacgtttcatggctccccttgaatttggtagtgtctgaatcaatacggatggtacgtatctgaggaaaaatctgctggagaattttttctattttttctgttcctgagcctcgatattgcaacgtcatagttccaagacattttggacaagattgtgggaggtctttaggtgaggagttgcatagatggcagagaagcacatttgcatatttatggaaggtgagcaccatgtcacaatgagggcatttcaatgtatgcttgcaaacagtacaagagacgttggtatgatatccccgacgattaaagaaaatcaaaacctgctctcccacttccagacgttcggctattttctttaacacaggctgggaaaatagaatcttggtttttgacttttccctctctaagttcatgttgataagagaaatttttgcgggatgagcagcagctgctcttgaagagagccgagacagaacgtacttgccagatagcgcattagtatagctttctaagctgggagtcgcacttcctaaaaccacagtagcatgagcgagtttgcctcgcattacagcgacatccctggcatggtagcaaggaggactttccgtttgtttataggcgggatcgtgttcttcatctacaatgatcagtcccagattcttcatggggcagaaaagagcagaccgtggtcctatgaggatacgtagggatccttcggaagcttggcgccacgtgcgacttttgtcgctgtcgctaagcttgtgatggagaacacctacatccttgccaaagcgcgctttaaataatgagactgtctgcactgtgagagcgatctctggaacaagaagaattgtacttttcccttgtttaagagcctcgcttgttgctcgaagatagatctctgttttaccacttcctgtaattccgaaaagtaaatgtgtatggaattgtgaggtttttagtgaggaaaaaattttatctatagcactttgctgttcaggatgtaaatccttaggagcaggcgggaaaaaggttaggaggtcttcttgaagctctaactgcgctgcatctacaatatcaagaatgcccagcttttcaagagaatgaattggagattgcgatactttggcagtctccataagggaagataaacccggtggggacgcatgttgtagtagaatttttaaaacagccccttgagaaggatgtaaaacttctaattttgcaagaatctctttagtttttgctttactttgctttaagacgacacggtagtgctgcttaggctgaatcacattcgaagagatagcgggaagaaataattttagagttttcccaagaggagcaaagtagtattggctgatccaaaatagcaagtctagaagatcttgaggaaggacaatctctgaatcggataatcctaagataggtaaaattttcttacattgggtcgttgtttttatttgataaataactccaacttttttccctccccgtaaagagatagtaacagcagttcctttagtaatgtgctctagattttcaggaacgccataatcgagtaccttgttgatgttagagcctacgatgacttcggcgtataggcgaaaggtagacgattcaatatagcccatagatttcgttttagctgtgaatctttttcatactctagtgaagaatagaggggaagaaagatacatccattttgtgtcagagattgatgataatcagttgtaggaattttataacggatcacatttaaaggggctagagctaaaaaaaaattggggttgtttacgaagatattcgtcttcgcatgaatcaaagtcaactttgtagggaaaagttgttgcgtaagaatttttgctaatctgttaaaaaacagcacttcttcgttgttttcttcataaacaaaaatagagcaggggatcttcggagcaggaagactacaatcttttaaagcgggatatttctcttttaaaatagcattttgtgacaggtctggatgcagaggaacacatttccaatctgaaggcttagtcttttcttgagaaagatttgtcggtggaggaggggtgattggttggggttctgcattggggacttctacagctttctcaggtatagaagaaacacttgcagagattgcagtattcggaagagttacattcaggagagatgcaagtgttggatagagttcctcagaataacgatccaaaagttgacagagagtgtcatgaaaattttgagagttttccataaatagccaatgtttctaaaaaagagaggtacgttttggtacccataaaaggagagctctctgtggataagaatttctattcttattttatcctaaatcagataatagtgtcatcatactcaacaaacttattcgacacgtttttttaaggatagtgacatgaaattttggttgcaaggatgtgcttttgtcggttgtctgctattgactttaccttgttgtgctgcacgaagacgtgcttctggagaaaatttgcaacaaactcgtcctatagcagctgcaaatctacaatgggagagctatgcagaagctcttgaacattctaaacaagatcacaaacctatttgtcttttctttacaggatcagactggtgtatgtggtgcataaaaatgcaagaccagattttgcaaagctctgagtttaagcattttgcgggtgtgcatctgcatatggttgaagttgatttcccccaaaagaatcatcaacctgaagagcagcgccaaaaaaatcaagaactgaaagctcaatataaagttacaggattccccgaactggtcttcatagatgcagaaggaaaacagcttgctcgcatgggatttgagcctggtggtggagctgcttacgtaagcaaggtgaagtctgctcttaaactacgttaagggattttataacttatttttgagaccttccttttttaagttgaatgtgagaactttcttacaaacccttggattaggataaggtctcaaaaaagtgcgtaggatattaatcaggttgctgagactttctgttttcagaatctaaataattagagatcactgctgctaatctgtctactacatttggactgagaggatttagatggagaagatccctttcgggtataggaattttagtccccgaggtttttacttcaggaagctctagaaaaggtgttgctacgcaattttctctttcgaagaggccgtcgctaatgagttcttgatcatgattagagttgtaaatgaaaatttcgggacaacgcaatctttcgctaggtttcacagagtctatgttccaaccaacgagttttataatcgcggaagctatgggcttacaaatttgattcgcgacatctgctagagagcgagggccccgatcttttacaacaatccatgaagttccatcactgccatcagtgacctcacgatctagagcagcagcttggacactagttcccaaagagtatccgaaagctatgatttgattggctttaggacctgtctcttcatctcgtaggtagcgtacgcatgcctgatacgatttaaccagattttctcgtttcgcttctcctttgctggacataattccaggatagttgaacacaagaagattcgagccggttgctttggctagctggtgtagagaggaatcgccccgatcgaacaggttttccatcaatccagagtttccttgagaataaagaatccacctgtggggaagagcatgaggtatctttatagctaagctatcaaccaccaaatcgtcatattgtataaccacacgatcggcagctgagatttccttaaggcttaggagttgtttaatatgggacagaaaggtcattcgccgaattgccacagctgtttttgacatgctctgagatatgatagaagatgggagaatgaaaaactgacaggttttcttgagtacccacaataacgctaagggaaggaacagaatgattgagataataaacttcacaatattccaaatcgttcctagaactttaaataaggtgggatgggccttccgtctttcagaagctatctctgttttttttgaagagaacatgattaaagacggctttggatccgtctctagaatcgtatcatcacgaaagtttattggggtaggggatgggatcatacaagagtcctaaattttaggtacacagagtataaagagaacaaaagaaaaagaatacgcattataattttttaattttttctagagagactctcaaggattgcttcagcaagcttttgtattgtagggtgtttcagagggcttgagtggagtagatttacctctcctataaattttttactcctggcaaatggggttcgttttattgcatgagcaagagtaaactccgggagcaatgcggtatcatcaccaacttctgaagggcgaaatcgatccgcagaataaacaagaatttctgggcaaggaagctctcggctgtttttttccgcatccattttccatcgagcgaggactgcgatgagttttcctattggcccgaagaaactattagcagctgcgggtaaagagtggggagcacggtctttgactgctacccaagaagtctcgctatttgtaaaaggatttttttgcaaagctgcagactggactacccctcctaaggaatatccgtaggtgatgatttcgttagccccagggccctgaattttatcttgtaggtactttgcacatagattatgagctgtcgctaggttctctaagttcaattttcctgtgctcgacttaaccccaggatagttgtaaattaggatattagcgcctagcagtttagctaactctttccaggagagaaacaaggaatctttcaggcctatcatgtcttcgaggaaatctccacttcctagagaaatcagcagccaacgtttaggccttgccgtactgaaatgtattgctaaagtatcaatggtaagatggtcttgttggatcgtgattcttttactttccgagactgctgggtctttgaaagagggatctagattctttacaaaataatcttgtatttcctgttccaaacgatactttttaaagcaggttttcaagacgctgtaaagcatcgaagaacgggggaaaagagccaaggaacatactaattgacataaccaataaattcccaggggcggaataatcagaccgattaagagtttgaaaattttaacaatgatcgtaacaattttggtgagtatggggtgcttcttactaaagtcacttaactgcttggcgtgtgttgacgaaaaataggaaactggatgaggatttgaaaatattcctgacaaaatatcagacctgtttgaaagattcaaaagagtgaatgcgaaatccttacgtctctaatctcaagggactggggacgtcaggtcaaacaaagttcagtgttatcggcggctgtttttcgcgcttatattataacggtgtccttagaaagattaaatagttaagtgcctttaaatctgattcttaaggagcatcccttctttctaagagagctttttcaaaattggtgtggcaagagccactcttgttttgctgtcgatgggatcgatatcagacgataatcgtacttctataaattctttattttgaacatagggactattttttatcgcatgagcgagagtaagttcaggtgctaagagcttgttctgtctgactgttgatcttcgtaaggaatccgtaggatagagaaaaatttctaggcagggaaggtcttggcttctctctacggctttggtcccccagccaaaaagacgagctactagctttcctatgcgtctgcaactgtggaaaccttctggagatataaagagaggacacctatctttgactgctatccaagtagtatcatcgtttgcaacaatcttctggtctcgcaatgcttctgcttgtatcaaacctcctagggagtacccataggtaatgatttcttttgctccagggccctgttctttatctttaaggtatcttgtacaaatattatgagctgatgctaggtcctttaggctgctgctccctgtgctggacatgactccggggtagttataaacgagtatattggcccctatcaacttggcaaatctttgccaagaatcaaagatctccttacaagcgatttcttccaagctacagtcacttcctaaagaaatgagcatccaacgattcgtaggtgcttgtgaaaggcatatttccaaagtgtcgatgagaacattatcctggaggataggaactcgtctcatggaagcaacgcggtttttcgaggaataatcttgcaaagcatgcaaataattagtttttaaggttttagtgttgggttgcttcttgaaaatttttaataaattcttggaagggagaatcgagtttgtacaaagcgtttgacatagccagtagattcctaagggaaggatgatcagccctatcagaactttaaaaattttaataattacagaagcaatccgtgtaagcacgggatgcctgtctttaaactcatgaagtttttgggcgcgtgttgaagaaaaataagtcgcttgtggagaagggtgggaatgtaaaatatcctcaacaaacgcattacttccgtgaattggagccatgaacttttcctataaaatttaagttctttttacggaactacttggtttttgatttgttcgtatagagggggggggttcaggtagaatgttgccgatatggagtcgtctagagcaggcttcaatgtctgtccacaaaagtttgtggtcttttctttattgccatccaagaactgatctagctttacagttagtaagattttcaggatcgaattctaagagaataaattttaagcaataagggaataaaaaagaatcatatcttcactcggttctgactttgtaaagaagtttatcctcattcttgattacacgaatgtaaccaactataaacaaatttttttgaggagaaaatttcttctactgttttggcctgaactcaagttgtttatctaaaagaacttaaaaaatacaacagctctttctttagaggatacagaaagtcgagttatagatagagattttactaacttaaggataaatattaaaatatttatttaatattccaagagtttttatttgatagtttctatttttaattttaatttattaattctttaaaataagatgagcgagctcgccccctgctcgacaggattgcagatggtcccccatacgcaggtccatcatgcccttgatacgcggagagtcattctaacgatagccgcctgtctgtctttaattgcaggaatcgtgttggttggcttaggtgctgcagcaatcctgccctcgctttttggagtcattggaggaatgattcttattctgttttcttcgatcgccctcatttatttatacaagaagacaagggaggtggatcagattgctctggagcctcttcctgagatgatttctaaagatcaaagcattatagattttgtaaagacacgagactatgcatctttagaaaagaaagcgacctttgcttatactcatactcattattacgatggaagcatggtcttctatagggagatccctagatttatgttaggctcttatctcgcgcttcgcaaagacatggaccgccaagctcttttttgaagaaggacatccatgttatgttgctcgccaggcttttaattcagggattcgactctatcgtcagttatttgacatagaatatttaacgaagctatacaaaaacaaggattacgatcctgagcatcgacaaagtttaaaaagcctaatagattggatgaaatgcgaagaccatggggaagactttttgcgtcaacatcggggctgtgactacccatcttctggctatacgggaatgtttttcaaacattcttaagtctttgtccgcatcctgaatcttgcatctagaatttctttttcataatctcatccttcatggtttagaagatttgttttggtgtgtcttagttcacgcaaaaaagtgggagagacttgtaagggagacttctttaactaaatgactatcgattgaaagaaggagttttgtatttagaaaagcgtattcttcttaaattttttactgatacatacatagaatgtatagaagtatcagaatcttcaaaagactcagagtgatcaacaacagtggatccatttatagaagtaaaacaagagctgtactaccatttagaatataggccttggttttgctcggggaaattccatgatatctttctttatgaatctaaagttttcctagagcgaagagagtcaaaaactcagtaagctatataaaatttgccgtgtaattaaagcatcagatactctgtctggtgggatcggcctgctttttacaactttagatagatagattttagagtcttgggttggaaaagcgatatctatacaaacatactagaggaaagaatgacggcgagagcagaatatttagaccatgaggattttttatataggagtcacaaacttcaggaactttctgagttgggtgtagtcctttatccttacgagtttcctggagttttttcatgcgaagatattaaaaaaacgtttgctagtcaagagttagggaatagtgaagctgctatgagtaggtccactcctagagtgcgttttgctgggcgtttggttcttttccgtgcgatggggaaaaatgcttttgggcaaattttagaccataatcaaaccatccaagtgatgttcaaccgtgagtttacctccgtacacggactttctgaagatgctgagattactccgattaagtttatagaaaaaaagttagatttaggagatatccttgggatcgatggctatttatttttcacccattccggagagcttaccgttcttgtagagactgtaaccctactttgtaaatccttactttcgttgcctgataagcacgcaggtttgagtgacaaagaagtccgctaccgcaagcgttggttagatctaatttcctcaagagaggttagcgatacctttgtgaaaagaagctatattattaagcttatccgtaattatatggatgctcatggatttttagaggtagagactcctatattacaaaatatctacgggggagcagaagctaagcctttcacaacaacaatggaagctttacattcggagatgtttttaagaatctccctggaaatcgctttgaagaaaatcctagtaggaggagctcctcgtatttatgaactcggtaaagtcttcagaaacgaaggaatcgatagaacacataatcctgaatttaccatgatagaagcgtatgctgcttacatggactataaagaggtcatggtctttgtagaaaatcttgttgagcatcttgtccgtgctgtaaatcacgacaatacctctctagtctattcttattggaaacatggcccccaagaggtagattttaaagctccttggattcgtatgacaatgaaagaaagtatcgcgacctatgcaggtattgatgttgacgttcacagtgatcagaagcttaaggaaatcttaaagaagaaaactacctttcctgagactgcatttgcgacagcttcccgggggatgttgatagcagccttatttgatgaacttgtctctgataatttaatagctcctcaccacattacagatcaccctgtagagacaaccccgttatgtaaaactctgcgttccggagataccgcatttgtagagcgcttcgaaagtttttgcttagggaaagagttgtgtaatgcctattcggaactcaatgatcctatccgtcaaagagaactcttggagcaacagcatactaaaaaagaactccttccggatagtgagtgtcatcctatcgatgaagagtttttagaagctctgtgtcagggaatgccccctgcaggaggatttggtataggtgtcgatagacttgttatgattcttacaaatgctgcatctatacgcgatgtgctgtatttccctgtaatgcggcgcttcgatgcagagaagacgaattaaaggggcttaactttaggccctgacttagagtcttcgacaaggaagcctgcggcaagtatctcatcacgtaaggtgtctgccatcgcccaatttttagtttttctagcttcctcacgttctgcaacaagttgcattacggtttctgggatgcacacgcttgtggttagaggaagcacaccaagtacagtatcgacttttttaagagtgtctaagatatagagagagtcggctttagaaaagtgcccttggtcgatcaaggtgttgatttcgtgaacaaaatcgaacagagatgcaaatcctgtagaaacatttaagtcattagcaagagctcttgagaaagcttctatgaattgactgctagagtccaaggttctgggaaggggagattccccagggagatctacgccttcaagtcgagaaacaaaatcttttaagcggcgtaaggcatgcctacaggcaaggagagcttcttctgtaaagttgagttgcgtacgataatggctttgcagtagcatatagcgtacttcttgaccagtaaattcctggtggagaaggtctcgtagagtgaggaaattccctaagctctttgacattttcttcccatcaataagcagatgttccgaatgcagccaatagcgtgcaaagggtttccctgaaagagcctcagattgggcgatttcattttcgtgatgaggaaatatattatctacacctcccgcatggatatccaaagaatctccaagaagttccatcgccataatcgaacattctaaatgccatccaggtcttcctttcccgaaaggactttcccaataaatgacgccatcacgttctggattgtatgctttccacagtacaaaatcacttgggttttctttgtcatactcatcagcagaaattctggagcagcagcgtaagctacttagatccagatgagagagcttcccataatttggaaaacggtttagagaaaaatatacggaagcatcctgacctatataggcgattccttgctctaagagctttgtaatcgcttggatcatttgagggatgtagtgtgttgcgtgtggatagaaatctgctctagcaatatttaaagtatcgagatcttcaaaaaaggcttcggtatatggctgcgtgtattcttgcagcggaatattttttttcgaggctcctgctatggttttgtcttctacatcagtaatattcatcacatgggttacagagtagccaaagaatactagagtgcgtttgagaatatcttcaaagacataagttcggaagttccctatgtgagcgtagtcatacacggtaggaccacaagtatatagtcttacaggggtgtgattggggaaaaaaagttcttttttttgagatgctgtattgtagaaatagagaccctcgatatgagaaaatgccataactgtatcactcttgactcaggagtttgttgttatatagacagagagaatttaacgtcagtctcttcggcctatcctaacaaaataaattttctagatctatgatttttgctttcgaaaatcttataggagaaaagatagcaaatttccttcttttcaaaagaaataaaaaatcgcataaatattcttagaatttcatatttattcatgcaatagaagctaaactttttttagtagcgaagttcaacgtttttaagtagtgttttttatttcgttttaataaaaaaaagactatacaacaagagtcgctagaaagatgttctcgaggcatatctggcccgccctgaatagaataaattgcgtcctaatcttaggaaaggaggaggtagcccgtgatcctgttacaaaatatcaaaagatgttccttaaaacagttgaaggtcttggctactcttttgttgagcttgagcttacctacgctagaagcagccgagaacagagattctgattctattgtttggcacctggattatcaggaggctttgcaaaagagcaaggaagcagagcttcctttgcttgttattttttctggttccgattggaatggcccttgtatgaaaatccgtaaagaggtgttggaatcacctgaattcatcaaaagagttcaggggaagtttgtctgtgtggaagtggagtatctgaaacatagaccgcaggttgaaaacattcgtcagcaaaatcttgctttgaaatctaaatttaaaattaatgaactgccctgcatgattttgctctcacatgaggagagagaaatctacagaataggttcttttggtaatgagacgggttccaatttaggggacagtctttgtcatatcgtagagagtgattctttactaagaagggcgtttcctatgatgacgtcgctatctttatcggaactgcaaaggtattaccgacttgctgaagagctctctcataaagaattcctcaagcatgctcttgagcttggggtgcgcagtgacgattacttctttttatctgagaagtttcggttattggtagaagtgggcaaaatggattctgaggagtgtcagagaattaaaaaacgccttctcaacaaagatcctaaaaatgaaaagcaaacccattttaccgtagccctgatagagtttcaagaactggcaaaaagatctcgagctggtgtgcgccaagatgccagccaagtcatcgctcctctagagagttatatttctcaatttgggcagcaagataaggataacttgtggcgtgtagaaatgatgatagcgcagttttacttagattctgatcaatggcatcatgctttgcaacatgcagaggttgcctttgaagctgctcctaacgaggtgcggtcacacatttctcgctctttggagtacattcgccaccagtcgtagctttcgtttttccaagacgatgtaacccctctgggatttgatttataaaatcctggagaagttttgaaaagacagggcgctgtttatgtcccttggggaaaacaacaatttgacaattgggaagttggtggcggacatgccgaaatacttcacgaacgacacgtttaaaagagtttctttcgtgagctttgccaaattttttagatacagtaatacccatcctacaagtcccgggatgcctagaagggaccacgtagaaagtcgcctgactaccacgacaacaaaaacctgaacgcgtaatgtaaagaaattgctttcttttcaaaacgcgggattgttttggtaaggtgagtgggtgcacgaaatactaaattataaatcgactagggaatgcctaccgtggcggcggcgacgattcaaaagttttcttccatttcttgtggccatacgagtacggaaacccacagaatttcggcgtttccttttgctaggttgataagtccgtttcacagtgtcttcctataattccttgcctcattcacggttgagtcttactaaagaggctttgcccgaaattttagaagattatatcaataaagatcaataagaagacatcggctttcttccaacttatctaagaaaattcgagagatgacagtctggtattgtcaaaaaagctcctaggagattaaattggttccttgttgtaacttagtatgcttctcctttttatgagaagtgaaggtaatatctcatgaaagttagttcatctgttaaggctgatccatctaagggggacaaattagtccgccgtaaaggacgtctttatgtaattaataagaaagatccaaatcgaaagcagcgccaagcaggacctgcacgtaaaaaataatttaaaaatttaggtaaaacgcatggcgaaaaaatcatcagtagcaagagaagctaagcgtcgacgattggtagaggctaattttaaaaaacgatccgaccttcgtaaaatcgtgaaaagcttgtctgttagcgaagaagaaaaagaaaatgcccgtatctctttaaataaaatgaagagagatacttctcctacacgtttgcataatcgatgcttattgacaggccgtcctagaggctacttaagaaagtttgctatctctagaatctgttttagacaaatggcttctatgggagaaatccccggcgttattaaggctagttggtagtctattctgattagagccccaaccctatttaaggacgtggggctttattttgatgcttctttcaaagcctgttgtagtgatggaacatccttcactcgttgccaatctttcattccctttttccatacccaaatttcttctggatacgtttttccctttaaaagtacgaccaactcctcaaaagatatcggacctacgttttctctatctttatttaaataaaaccacttctctgtatcgataacgatttcttgaagatctcccgatgagggtatctcgtcattacctgctaaactttttttcaaatcatcaaaaagatcggagttatcaaaaggatcgttttgtggcttttctaaagcgtttcgacgagaaggaagaagaagaaggacaactagaccaataaatccaaaaaatgctcctgcaaaaaaccagccaataacatttcgttttttcttatctgctatgtaggcagatagacaacctagaatcacataaaataataaaatcgaaatagggagcatagtgcgtagcgtacctgaaagattaatagtctgtcactaacgcctattatttccatgtgttgtatttctcgctagagaaatagggcacgtttcataaggaaacgtagaaaatacaagtcttaaattaaaaatatcagttcaagaagaacaatttcagaacttttctgatgccatatagtagtgaaaaagagaaggtagatctatagacgttaaagtggataaaaaaactcataggcaagagtgcgactttttttctttactagcagagcggtaggggaacctagaagttggatctaatggatgtagcatattaaccgctggacgattagactgtcgctaacacttattatttccaccgtgttatatttctttagtgaagaaatagagctcattggaggaggaaaaatggaaaaacaaaatttaaaattagatgtcaaagagattgagtttcctgaaacggtattcagccgtgatatcgaaactcgtgttatccaagtaattattttgcattgtttagcaaaaattaacggtgtttccctcctcggaggaaatctaatagacgctctgttcggtagagatatcgaaagaatgaaggggatctatgtagaacaggattcaaaaaatcatctggtcaaagttcgtgtcgaagtgaacgtagattacggtgtttctataccagagaaaacagaagaaatccagggatgcattgtttcagaaatttcagaatatacaggacttcatgtggccgctgtccacgtgatcattaaagggttgacacaaccaaaagatcgtattgatgaagaaattgaagaggaagtctctgttcaagatcttccttcacctgaagacttcttacttgagaattctgaagggtagacttaatcagatttgttgaagtctttttgccttgcaagaagcactgcaatatctttcttagttagcccaggaatagcttccagctcttcctgggagctaagcattacctgtttccaacttttaaatttctgcaacaatcgttttcgctttacctctccgattccagggattttttcctgttcaaataaagcctttcctctttttttcctgtgcttactaatcgcaaagcgatgtgcctcatcacgaaggatctgaaaaaattgtaataaattagaagtcgggggaagagaaaaaccctctgggaacgtctcgcagaaaatcttctccttatttaaccctcgactatgattacttttttcttttgcgatagtaacaacctgaattcctgtaagattgagagtttggattattttttttgtcttgttatagtgcgttttccccccatcaaccacaatcatatcaggaagagctgtggtcagtgaatgaaaccttcgtaagagcacttcttctaatagagccaagtcattctgagtcttttcagaatctatggaaaacgtacgatattgcttgggatcgaacccattattttcaaatacaatgtacactccagtagcgtgagcaccttgcatatgagcattatcgtagcattctatccgatacggatattgtgacatccgcagtatattttgaaagtcttggtaggggagcgttgatgaaggaagtgtagttgctgcatacgccttggcattgcgataggctagatcaagaagttcttttccatatcctgtttttggagaacgtaggcggggaggagactccgcattcaatacgtaggagagagtaggaaattctaggggaagaggtgtcagaatttctttaggaatgtagggttggctaacataatattgcaaaataaaagaggagagcaagtcttgatcttcttgagcattctcaaagaaagagaaatggcgtgccccaagaagcttccctgagcggacagtaagtagcgtgaggatggtgcgttgtttatgtctgtaaagaccaagagcatcaatattttgaaaatgaaatttttccacctgttgctttgccatagcttgcttaattagggacaacgtgcggtagtaattcgcagcttgctcaaattctaagttatcggaagccttttgaatcactttttctaagtccttgaccacttcttcgatctttcctttaagaaagaggatcgccttgtctaaggttccttgatattcttcaggagtgcaatagccgacacaaggagcaagacagcgcttcatgtcataaagaatgcaagggcgtttccttaaggcaaactctcgatctgaacaagtcctcagaggaaaccattggctgataacctctaagagagtgtggcaggcttcagcacttacataagggccaaaaatcaattgtcgttgtgaagaggttatcgccttcgtgcggatagcttccactttgggccacgaatgtgacagggaaatcgcaaggcagaaaaaggttttatcatctttgagcaacacattgtatttaggatggtgctgctttatcaaattgttttctaaaaggagggcctcagtttcattcgacacaacaatagtttcaatagacgcggtctttttcatgagaaaagggatgcgttctcgagagtcccctttctcatgaaaataggatgctaagcgatttttgagatttttagccttgccaatgtagaggacttgatcatggacatccttcatcaggtagactccaggagaggaaggaatgagtttgagagaaaaatcctcaatgcgcataactagaataatgtcagttgttgcatcttatcttgagcagggcgtgtaatggattccgggccttctaattgtcttaggatctgctgagctctcgataccacacaaaggggaaagccagcaagcctggcgacatgaatgccgaaacttttttgtgaatgtcccttgagaatctcatataagaaaacaggctgccctgctttatctttaactccggcatgaaaattttcaacgtgcggacaatggtcttctaaagtcgtcaattctttataatgagttgcaaaaagcgtcttagctttctttttgtcagtgaaaaggaggtactctacaacagcttgagcaatggcaaggccatcataagtactggttcctcttcctacctcatctaggatcactaaagagcggtccgtggcattgtgaaggatattcgcagtttcggccatttctaccataaaagtagacattccttttgagaggttgtctccagcgcctatcctggtaaaaattttatcaatcactccgatgtgagctgattttgcagggatatacgaccccatttgagccataatcacaagaagagctatctgacggatataggtagattttcctgccatattaggcccagtaagtaagatcattcgagtttgagagccacgcatttcagtgtcattgggaataaatttccctgtgtctacaagagtttttgctacaggatgacaaccacgataaatacataaggtgtcactcatatctacatgaggacgacaatagccctgagcatgtgcaagatccgcaagagaaatgatgtagtctagatcagcaagactttgagatagagccaaaatctcagtgcgtaactgtaggatgtgtgagcaaagatccttgaagaattgcgtttctaaagtttgaagtttttcagagatattagacatatcatcttggaattgctgcagctcaatagtagtaaacctttctgcatgcaatcgtgattgccgacggatgaaatctttaggaagttgaggagcaaactcgctgctcacttcaatataatatcctaaagcctgagcaaagcagattttgagttttttgatccctgtttctttacgaatgcgttcttggtattcccaaatccattcttgagaatgctcttgattgtggcgtaagcgctttaaatcattgtggaactcatccacaaaaatatttccatcagaaactcggagagggaggtcgccgttcaaggactttgaaagcagtgcaattaaggaggctagctttgtatctaacgagcatttatctataaagaattctggaagagtcgcagaagccagttgttcgtagatttgagctcctgcagaaaaagaatctctgagtgtcccgatatctctaggccctgccaatcctgtggtcactttggtcatcagtcgttcgatatcacgtacttgacaaaggtacgttttgatattttttcttaaagtcacttgccgaaggaaaaattctacagcatcttgacgtacaaggatctccttagggttatagaaaggactgatcaaaatttgacgtaaaagtcttccccccataggtgtgcttgtatgatccatgatacgtaagagagaatttttcccctgaggatcattcaagggagcgaggagctcaaggttcacttgagatgccgtatctattaataacttttgctgttttccacgcgtttggggaatcgcaatatgtttcgtaggtaataaaagtttatcttggatataagagagaaggcctccagcagcgttgatcgctgggacgagccctttcaggccaaatccatctagggaggccacttgaaaatgcgttgtaagtttttgagaggcgaacttatgttcaaaggcccagtccgcatacgtagataaggtcagcttgaggtgttgttgcaactgcatgacaatagcagtttctttattataaaatttgttacacgagagcacttcagaaggagcaagacgacagatctcgtcaacaagctctttggtattctcacattcttcaataaagaaagatcccgtagaaagatctaaacaagcaaaaccaaacagagacccgatacgattgatagcaacaatataattattgaatttttcctggagcagggtggaggatagcaaagtgccaggagtgacaaatctctgaatatcccgggccatgggaccgatttttttactctctttttcttttgcaggctcgccaaattgttctgcaacagcaactttgaatcccttgccgatgaggcgatccacataggtatcaacagtagatacaggaatcccactcataggaattccctgtcgttgtgttaaagtaagttccaaatgttgggataaaagaaccgcatcgtcataaaaagcttcgtaaaagtctcccatccgaaataaaagcacagaatctccagctttttctttacactgatgccattgttccatcatcggggtaggttttttttccgtcataacttattcgcaatgtacgttattgttttcatatccattaggattcaaatgtattgagctaattgattactgctttattaccgtggcttttgctaacggttgctttgactatacaagaaagtagagttttcgaacgagcctctaaaattcctgagagacagcctcagttgtaaatctagagtgggagttaagaatgctgcattacgagccggtccccttgagaaaagataaacaggatgggatattaattccaaggcaattctcggtagtaaatccttccctgggatgctgtaaatagaaaatttctttttataagaattccctaatataaaagaaattcatccagaaagaaaagctgcattagacaaaatacagaggtaaattaataattggggagagtctctttattttatagagcctcagtctttttaaactaagaaatctgtaagttaaaattgcagcataaccaagttgcgtaccgctatgtatacggaagagagcttagataacctgagacacagtatagatattgtggatgtcctttcggaacacatccatttgaagcgctccggtgcaacatacaaggcatgttgtccttttcatacagagaaaacaccttcgttcatagtcaatcctgcgggtgcacactaccactgctttggatgtggtgcacatggagatgccattggcttcctcatgcagcacttgggatactcttttactgaagccattttggtattatctaaaaaatttcaagtagacctagttctccaacccaaggattccggatacacccctcctcaaggactgaaagaagaattacgtcacatcaacagtgaagctgaaacttttttccgttattgcttgtatcaccttccagaagcgagacacgctttgcagtatttataccatcggggattttctccagatacaatcgatcgattccatttgggttatggaccagaacaatctctttttctacaagccatggaagaaaggaaaatctcacaagaacaactgcatactgcagggttttttgggaataaatggtttttgtttgcacgaagaatcatctttcctgtccacgatgcgctaggacataccattggattttccgctaggaaatttttagaaaactcccaagggggtaagtatgtcaacactccagaaactcctatattcaaaaagtccaggatcctctttgggttaaatttttcacgtaggagaatagccaaagaaaaaaaagtcatcctagtggaaggacaggccgattgcctgcaaatgatagattcaggatttaattgtacagtggcagctcaaggtacagcatttacagaagaacatgtgaaagagttaagtaaattaggagttttaaaagtcttcctgctcttcgacagtgatgaagcaggaaataaagcagcattacgtgttggggatctttgtcaaactgctcagatgtccgtatttgtctgtaagctaccacaaggccatgatcccgattcttttcttatgcaacgaggaagctcaggactcattgctttattagagcaaagccaagactatcttacgtttttgatcagtgaaaaaatgagttcttacccgaagtttggccctagagaaaaggctcttctagttgaagaagcgattcgtcagatcaagcattgggggagtcctattcttgtatatgagcatttaaaacaactagcctccttaatgatggttccagaagacatggtattgtctttagcaaaccctcaggtaacagccgaaccacaaaatattcccataaaacaaaaagttcccaagatacatcctcatattgtgatggaaacagatatcttgcgttgtatgcttttttgtggatccaatactaaaattctctacacagcgcaattctactttgtcccggaggatttcaaacatcccgaatgtaggaaattgtttgcgtttatgatttcctattacgaaaaatatcggaaaaatgttccctttgatgaagcctgtcaggtactttctgattctcagattcttcaactgttaaccaagcggcgcctaaacacagaagctctcgatactatcttcgtacaatctcttcaaaaaatggcagataggagatggcgagagcaatgcaaacctctctctcttaaccaaaatattcaggataaaaagcttgagattttggaagactatgttcaattgcgtaaagatagaacaataatcacacttctagatccagaaagtgagctcattccttaacccagctcttcttttgtaaagaattcttgtttttctaaatcccccggatttcttagatgtttcctaatttccttggaggaggaacctgcaatgatgtgcctttcaataaaccggaaagcggcgtaattcctattaaaagcaacttacttataatttattgaaattttaataaatataatataaaatgttgtttcgtttttatttttattattagttttttatgaaatcttttaagtttttgttgccatttttaagtgttattctttgctgtggaaacctactctcttctccacgctccagagcaatttcagtgaccgaatccattggaatgtcggcagtgaagactcttgttctatctgagaaggctcatgaattcttagagggaatcggatatggagttggagcatctagtattctccgcgactggcaaacacaacagtggttagaaatagaatccttattagcacaaaatgaggtgatgtaaatttgagatattttcacttacaaagtatctttgcctatttatatcggcgacctgttctctatagcttagcaagtatgattttctctactgtagtctctaaaattcatagcttgaccgcgatctagctttccaactctcatatccttatctatctccaaaaaatagattttataaaattataagtttaattctatctgtttgcaatttgataaaattgattatctgtgataacttactttaactttaaataaagatttttaaataaaaattatgatgcaccgttattttattcctttattagcacttctcattttctctccttctttagtcagggcagagctacaaccaagtgaaaacagaaaaggggggtggcctacacaactttcctgtgcagaaggttcgcaactcttctgtaaattcgaagctgcctataataatgcaattgaggaagggaaacctgggattttagtctttttctctgagcgacccacaccagaatttgccgacttaacgaatggttcattttctctctctacgccaatcgccaagggctttaatgtcgttgtgttatgccccgggcttatcagtcccttagactttttccacaaaatggatcctgtgattctctatatgggaagttttctagagatgttccctgaagtggaggcagttagtggccctcgcttatgttatatcttaatagatgaacagggtggggctcaatgtcaggctgtcctgcctttagaaacaaagaattagagtatatttaaaaacaaaattttgccatcctacttcggacataattttgatcaattaaggaggcattacatgcgtatcgcactatctctactttcattattaatgatattccctatcttcggagaggaaagtcgccctggttcagaagacggcaacagtaatacgcaggagatagtcggatctcaggatacacaggtatgtctttatcattcctatgaacagggcttgcaagcatcccggatcgaaggaaagcccctggttattgtagtactttgcaattctggtgatgatggccaggcatgcaccatagggttaagtgaaacatgtgaggaggtcctttctgtactttcaggatctattttttccgagttagctaacttcgtcgtacttgtcccttcaggagtgaacccactcatttatcctccaattgaagatccgattctcgcagagattgtaaagtttaaggagttgttcaaagatgagtctttccctacaggattaagtattattgttgttggtgtcactccagaaggacctggtgatatcatagaagtcagtccggtttcgttaaccgtagaggaagaagagacgctaccaagtgaacaaactacagaagtagagagcacgtctgaacttcaatcagaagatccagctatagcataaccaagatcttcccttaataaaagaaagcgctcgtaggattcctcccacgagcgctttctttatctaaatgttatgaaattatacagctacagattcccaatgacacaaggaaaacttatccatagcagtaagtaatagcgaaatccgtaagttgcggattgcaccatcatcattagcaatatgcacagtattcagaaaatcctgaatatcattggaaagatcagcaagggataagaaatattctaaaaaggcatgtgctgaagtttccttaggaaatccagggaaagcatcaagaacttgcttaaaattagattcacgatccccaagaacttcaataggggacgaagtcatggagagttttaaagaggaaagaatcttctttaaacgattgtgagtggtcgtaatcactgctaatttttctgtatgctcttcctttaatagctgaagggcttcagcagtatctaaaatctcaataggatttttcgttgcagaatctataagaacagcagcaatctcatccttacgaaactctagggatcccataaatgtttttaaccgaccccaaatgaattcaaggatttcgtgtatagtcttggacttatcccagaccttttcttcaatggtgctaggaaaatggtccgctagacgatctaaaagagaagcaagatctatagggagccgagaggcggatactagtgttaacacttctaaggattgacgacgtagtgcataaggatcatgcgatgacgtaggcttaagtcctaaaataaagcaagcaagcaagttatccaaacgatctaaaagagaaagaagagttcctatggttgagagcttttgacccatagtaatgtgtcgtaggtgctctcctacagcaaccgcagacgctgtgggaagattcgcatgcttcagataatactctcccatgatcccctgaagttcagggaattcattgacgacagccgacactaagtcagctttgcagtattggatggcaatgtctaggtcctcggaagccgctaaagaggaaaaagtagagaacactctttggtgtgcttttaaacgctctaccttgtcatataaagaacccaaagcttcaaagtatgtcacagacttgagcttttcaataaaggttgttaaaggagtctgtaagtcttgtttgaaaagaaattctccgtcagtgagacgaggagtgagtgccttttcatttccttcaatgattgtatcattcggagaattatcacaaactacaataaaaaagttagaaatagctccagaagaggtttcgtgggtagggaaatacttctggtgatttaccatctcagctataagtaactctttcggtaaagcacaaaattgctcggaaaattgcccacaagagacaaaagggtgctccgacaggaaggtagcttcttcaattaaacggggaagaggaatcgcagaaattgtatcagaactatgagctcgtagcccttgttctataatcatgcgacgctctttttgtgaaactacaacacacgcttgccttaaggtttctacataatcttgaggagaggaaatcgaaatttttctcggatctaattgacgatgaccaaaagaatttcttgaagctattatagtaccgagagtgattggtaagatgtgttctccataaagagcaactagccaacgtatagggcgggcatactcgactccgctgttatcccaaaccatctttttagggaatttcatcctctgaattaataaaggaagttcctgcattaagatatcagcagttcgtaaccttatctcaggatgtaataggaataaatattcagaaccgttgactgtacggatagctaaggaagcgtgacgggaaagatcttgataatgagaaatatccacaccctgagaagcaaaaaactgctggccttgaggagacacatctccatcaggagaaaataaagacgtcagcataggaccttttttctcaaaagccttctgcacgacctcaggagctacgtttttaacaagcaaagccaaccgtcgtggagagccaaggacctctaacccctcataaacaatattatgatcagtaagaacctggcgagctaacgattctagttgttgtattccaataggaacaaaagtcgcaggaagttcctcagaaccaatttctagtaagagatcctctgtagatgaaatcataggaactacagattctgatgtttccttaggctcagatgttgaagaaagactaagtaaaggataatttaaagaagcacgccactctacatagctatccgcaactaaacgagttaattgacggatacgagcaatataacgtgtacgctcagtaacagaaatcgttccccgagcatcaaggatattaaaagcatgcgacgctttgatcacgaagtcataagcaggaacagaaagaccatttttaagagttcttaaagcttcctcagcgaaatcttcgaaatgcttaaaccacatctcggtgtttgcatagtcaaaattatattcactccaagctttttcagaagcttgtgtaatttgtccatacgttaaagtgtcattccataagacatcataaatagagattttcttttgcaaatacatcgcaattctttcaatgccataggtgatctccccactgatagtatccaaaggtttactcccaatggcttggaaataggtcaactgggtaatttccatcccattgagccacacttcccaacctaagccccaagctccaatggtagggttttcccaatcgtcatgaataaaacggatatcgtgatcacgaaggtctaaaccaatggcccgtagcgattccgtatagagtgagagaaaattttcaggcacgggctttaaaatgacctggagttgatgatagttttgtagccggttcggatgcacgccataccgaccatcttgcggacgccttgaaggttctacataagcagccttatagggctcaggtcctaaggctcgtaagaacgttgcaggattgaatgttccagcaccaacttctaaatcgtatccttgatggatgacgcacccttgctcgctccaaaatcgtaagatagtcgcaatcatagactgtaaggtgaggggatgttctgacacaaatgactccaaggtataacattttttcttttgacattctccttagctaaagcgggagattcttgtttcattgaaggtagcatagattttaaagctacagtcacaccttctccacaagcgtagatttccgtgtgtctcacggtacgtgttaggatgagtatataccttttgaaaaatactgcagtacagaaaaccaaaagaaaataacgacatagatttaacaagatcagagaacaagtttttaaaacatcatttccattctaattaaattatatgaagattttttaccttttgacctaaaaactctcttgagtaatcttaagaacaatcctgtgagcagatgtttggattataacactcaattttgagttattttcatagtgcttgacaatattttcaataatttagaaaaattagaaaattttctatttagcttagagcaagagggttctcgatatacaaaaatggatcatgcgagcaattgattttaaggaaaacacgacttccttttaaattcaaagttatcctcgatcttgtgaataaaataactatagggtttccttaagtaagctagaacaaaaaatacgcagactgtgatttcagtgctttcctcttagtaaggcactcatctcatggacagacaagaaccatatattaggggagtagggtggggctacctaattacatcactttttccagactctttattacaccgattttcatgatcctgtatttaaaaggaaaatggtttggaatcactccagtagtgttgccttacgtgctgttagctctcctggcaatctctgagttaacagacgctatcgatggttatgtcgcaagaaaattttcacaggttaccgatttaggaaaactcctggatcctatggcagatagtatctacagaatttctatctacctaacttttacacagcctccagtcaatttacctttgcttctggtattcatcttcctagcacgggattctgtaattagtactttgcgtactgtatgtgctttccgtgggcgtgttgtcgctgcaagggctagtgggaaactaaaagctatactacaaggagtcagcttcttcttaattcttttggttatgattcctcactccctaggacttctttctcagaatggattggaaatctttgcctcagttacggtttcaatcatagctgtgtattctatagcctcaggaatcgaatacttctggatgaacaaaaactttttatcccaaagagctaaaacaaaagattcagaaaagaatcatgagagtaaagattgataaagatttacgtaatgcttagccatggcatctaagccagaggcccgaagcattcccgactcaatcaaattcaaccaaacgtcaggctcctgacgatacgtcgttacagcgttgctaagcatagcccgaaattcattaaaattgtttgtatcaaagaaagtgaaaccatttaccccaggaatcactgtatcagcaagccctccagttttacgaactaaaggaactgtgccataacgcatcgctatcagctgggtaagtccacaagcctccctatgtgaagggatgcagatcatatcggcagcagcataagttagcctggctaaaggatcattaaagtccaagatcaaacgaatgttgggggagctcgctaaacaatcttgtaagttacggaactcattaagaagaacctcattttgacttgtcccaatcaagataaaggcataactgtgctccatagcatggagaataatctctttcataaattcaggacccttttcctcaacaatgcgtgagatcacacaaatcaaaggaaaatagtctgaactgatccccaacttctcatataataccgctctgttctcttcttttttagtaaagagaacgtcaggttcgcttaataggcttgcatcgtactgtacagctaaagcaggatctgtcttcgggttccaaacgtcttcatcaatgccattgatgatcccagaaaatacagaatttcttgctagaatcgcatcatgaagttcgtaatcagaatagtcgtttataatttcctgcacataagtaagagacactgtcgtaatgtaatccgaacaatagagagctcccttcattagaacagaagtttgcggatcgcgaaatagttggtagtgactcaaatgaaaatcatcaatttgcgacgctgctaatagctgcgtactacaataccctcgataaccaaaattatggatagtaaagacaatcttcgaatgcacagggtttaaagggttttttaataaacccgcaagtaaacctacatgccagtcatgcaagtgcacaatgtcagcaggatccgcttcttgaagataagctgcagctgcagctgcaaaagcagagaaacgtacaacattattctcagagtacacggacgtggttgagaaaagctctatttgtgaatccaacgtaattatagtaagcgtaagaccctcgtaagaataagaaattgcagaggcttgctgcttgcctaaaaattcataatagaaagaacgctcggaaagaacttgagacgaagagaatttggaaattaaaggataatgagggagaagtacttccacatcattttgtttcgctaactccttagatagactagctacagcatcgcctagaccgcctactttaacgattggagtgaattctacagcgacttgtacgattctcatagactctccctaaagctataaaatatcccatatcaagggcgaaggtaaaatctcaagaccaaaaaagagagttttttatcattttcctattttcaaaaactgaagattcgttaaactaatgcctttctgttggggtgtggccaagcggtaaggcagcggtttttggtaccgtgcatcggaggttcgaatccttccaccccagagtccttttcttctccttttggtaactgtattctttagttgtctcttcttacaagaaggatatacgttcaattctttaattagggaaagtattgactttttccaaactggagatataattttgcctcgaaaactgtcgatagacgtccaagacatgacagtgattggccctctaagaaaatatgtttggactctcagagtgaatgcatagcgcacagctcttttagctcaagattacggagaaaacaacattatggagcttgtagttacaagtcgagagactggtaagaaatcttttcttaagaaaattcgtcagcaaggtggaatccctgctgtagtatattctgcaggcaagagccttgcgaatatcactgtggatgcacttgtgtttaaaaagtttttatcgaatttagaaagcggagccctatcttctacggtcttttctttgtcttatgaagggcgtataattaaagctctagttaaagatatccaatatcaaatcaccacctacgatgtaattcacctcgattttgaagaactcgtagaagatcgtcctataaagttaaatattcctatccgttgtatcaatgctgtagactgtattggagtgaaactcggtggatctttacgacaagtgattcgtgccgttcgcgtagtatgcaaacctaaagatattgtaccttttctagaacttgatgtgcggtctgttggactttctcaaacgagaaaactatccgatataaagatccctgctggaatagaaacaattacacctttgaaagaagtcgctataaccgtctctagaagataatatggctaagctcattgtagcgatagggaaccctaggcatgggtatgcaaatactagacataacgcagggttcctattggctgataggttagtggaggagctccaaggccccccatttaaaccgttatcaaaatgccatgctttaatgactctcgtagagtcttcttcagggcctttggtttttattaaaccaacaacttttgtcaatttaagcggtaaagccgtggttttggctaaaaaatattttaatgttgctctgagtcacattctagttctcgctgatgatgtgaaccgttcgtttggtaaacttcgcctttgttttaacggaggaagtgggggacacaatggtcttaagagcattactgccagcttgggttccaatgaatattggcaattacggttcggtgtaggaagacccctcgaagagggtgttgagctatctaatttcgttttaggaaagttttctgaagaagaaaatcttcagttgggatccatatttgttgaggcatctactctatttaccgagtggtgttcgaaattttaaatggcttgagaagtttctgaaataattttagtggactgagatatcttaaggataataaactactctatctgtctgtgtttaggagtttttaatgggaaaaaaagaaaatcaactttacgaaggcgcctatgtgtttagcgtcactcttagtgaagaagctaggcgcaaagctttggataaggttatttcaggcataactaattacggcggtgaaattcataaaattcacgatcaaggacgtaaaaaactagcgtataccattcgtggagctagagaaggttactactattttatttatttttctgtctctcctggagccattacagagctttggaaagagtatcacttaaatgaagatctacttcgtttcatgactcttagagcagattctgtaaaagaagttttagaattcgcctctctacccgaataatttgttaaggagaaaatatgaataagcctgttcataataatgaacacagaaggaagcgttttaataaaaaatgcccttttgtttccgcaggttggaaaacaatagattataaggatgttgaaaccttaaaaaaattcattaccgaaagaggtaaagtattacctagaagaattacaggtgtttcttcccgtttccaaggcgtgctatcccaagcaatcaaaagagctcgccatttagggttgttgccttttgttggagaagattaatttaaaggaagaagaatgaaacaacagctacttttacttgaagatgttgatggattaggacgtagtggtgatttaattaccgctcgccctggatatgtccgtaactatcttatccctaagaaaaaagcagtgattgctggtgcaggaactctgcgtttacaagctaaacttaaagagcaacgcttaatacaagcagctgctgataaagcagattccgaaaggattgctcaggctctcaaagatatcgttttggaattccaagtacgtgttgaccctgataacaatatgtacggatctgtaaccattgcagatattattgcagaagctgctaaaaagaatattttcttggttcgtaaaaactttcctcatgcccactacgctattaagaatttgggcaagaaaaacattcctttaaagctaaaagaagaagtaaccgcaaccttattggtcgaagttacctctgacaatgaatacgtcactgttttggctcaaggaaaacaaactgaggaaaatcaagaaggctaatacgtagggtagaaaagtttgttataaggatatcatgcaatacttttctcccgcaaagttaaacctttttttaaaaatatggggaaagcgtttcgataattttcacgagctcacaaccctttatcaagctatagattttggagacacactttctttaaagaatagcatgaaggatagtttgagcagtaatgttaacgaattgctttccccctcgaatctcatctggaaaagcctcgaaattttcagaagagaaacacaaattcaccaaccagtttcttggcacctcaataaatctattcccctccagtctggcttaggaggaggcagtagtaatgcagccacagccctctacgctcttaacgagcatttccaaacccatattcctataacaacattgcaactttgggctcgagaaatcggaagcgatgttccttttttttttcttcaggaacagcattagggaaaggtcggggagaacacctcttctctataaaaaaactcaaccataaacataaatatgttctctatctcgatcatcaaggaatacccacagaaaaggcataccaatccttacttccacaagactatagtacaggaaatcataacgcctgtttctatggtgaaaatgatctagaaaaatccgtatttcgtatacggacagacttgaaaaataaaaaacacatgttagagaggatgtggagtcctttcgaaagccatgtgcttatgtcaggttcaggagctaccctattcgtttgttatctagaagagttagaacaagattcaaaagtatcctcccaaatccatagcctaatcaaacaaacccaaggaattcccgttagccgtctttatagggaaccgcattggtattctctaaagcaatctacttacaaaaacagcccgctagagtgttttcagccacagatatgattttatttgcctctacagaaagtgagttttctgcttggcaaaatccatgaacattacctaaactcgccttttccttcagcacagagaatataagagtagaagcttcggaaattttcgttacttttttagcagtcgtttcatctgctttaggaagtgtaatcttgtaagacataaataaaccctcacattctcttcctacttaaaggatttttttattttaaacaatttcttttataaatgtgttttagcttcttaatgtgaaatttctatttctctacgagaagaaaaccagagatcttcctaaattttttgaccctttctttttactgtgaatacctttatgtctacgcataagtattaacttagctcgtctggttctctatgatcctgcctccatactcttattctttgaaaataggcgccgcagtgctctttttttgttccatactgcacacatttctgactccctggctctacactctatgtcagtcttacgaacataaaaaacttgttttcccagaatgctggaaacgctatgcccggttgtcagaactcttcagaatcctaagtagagtagaaattgtatttttcttgtgggcagtacccttgttcttctggtttctatataccgaaggatacaggatttccatggcctattttaatagtagaaattatggattcgctgtcttcattatggtgatcctcattttactagagtcccgccctatagtatatttcgcagaacttgtgctctcctcaattgcaaaattaggaaaaacctctcccaaatcctggtggtggacattgatgatcgcaccaccacttctctcctgtctccttaaagaaacaggagctatgattatcggtgcgactctacttatgagacatttttatgttttttctccgtcaagacgcttcgcatacgctactatgggacttctgttttctaatatttccataggaggactcacaagctatgtatcctcaagagctctcttccttatctttcctgcactaaaatgggaacactcgttttttctttcccacttcgcatggaaagctatcgtcgctatcctaatctctacaacaatctattattttatctttcgaaaagaatttaaaaagttcccagatatccctagtgacaaagatcctagcgttgaaaaagtgccctggtggatcatctgtgttaatattatttttgtcggttctataatattatcacgatccacacccttgttcatgggagctctactactcttttacttagggtttcagaagttcactatcttttatcaagatccaatcaacctttccaaggtatgctacgtaggacttttttatgccggattggtagtcttcggagatcttcaagaatggtgggtgctgaatctaatgcaaggtctgtcagatttcggatacatgacagtttcctatacgctgtccatattcttagataatgcacttgtgaactatctagtacataacctctccgtagctacagattgctaccactatcttgtagtcgcaggctgcatggcagcagggggacttaccctagtctccaatatcccaaatatcgtgggatacctcatcttaaggtccgcatttccctcatcgacaatccatatgggatggttgtttctcggagctttaggcccctccataatttccttgggagtcttctggttattgaaaaatgttccagaattcctctactgttttttcaggtaaactaaagataaaacaaaggcataagatatgatcttatgcctttgtttttaagaggtcttctgagtgccacgtatatagacgctagtttgcgtccctagttcattgctaaggaaacactgacagtattttaagaactcttcgtatgttaacgtttccgcaatagcaatcttcaagtcgggagtcgaaaactccacaaaaggccgctcaaatgctagagaaaataacgccgagttcatcatgtctaaggaatgctcaggctccaagattttattgatatacgctttgcgtatgtttgcgaatttctcttgcgatattccaaatttctcaggagaagctgagaccttgttaaggaacagagaagttttagcaagaagctcttcaggagaatacgcatccgaacggatatagagaaatccaaacggcctggaagcaaactctcgatagcgcgcacccaccatataacccaattgctgttgcgttctaagctcctcaaaagtaatgtgatgcaaccattcaaagagcatctccgcacaaaccttcccttgtatagacggggaactcttatcttgaagtaataagagcatcccgtttgcagttaacggatagtcatgatggatctcagaaatttcctgagactgtagctcgtaataaaagggctttgtagcatgcgaagatcgtgacgcagtgaaaacttgtagcatctcaagataatctttcttctgctgctcagaaaggttccctaagaccataacttcaagatgtacactgttgaaaaggttcgaggcaaacgcttggaattcagaaaaacttaacttctcaagagctgatagcttagtagtattagaatacgtctccttcataacttgtgaggcaagctcatcaagcccagaacgaaccggacagttgagcaaagctccttgataaagctctaacaactgctttttatatactaagaatgtctcatagctaatctctaaattaggtaatgaggttaaaattgagtttaacaatgcagggactgttgttgtgtaccctgaaactcttaaatcaataccatcaccacctaaagcagaagtaaaagaaagaccagcttgcgttgcgggataatactccctcaaaagctgatcattcacagctaagcaatagagctccgtagcaactagaaattgaggggaggacctcgaaatctgaggagagcggatgcgaatctgactggagagtttcggtgctgtatagtagtggtcctcgcaatggtacagagttaatttatcatcttggtaactgagtgcaggagcaaaaggaaattcttgttttttcagtaggtgtacaccaggaagagtcacctctttaggaataaacagattcggctttggaagagctatgggctttagtgactgcacctttccataatcctgaacaccgtccagagcttttacatagtaggtcatgtcaaaaataggatcgtggagctgagtcgcttcttcccaatgctcagagttcttactagataagacaaaacgtgcttgttcaggatcagagactaaattaagaagagcagactcgtcttcagaagagtatttaggatacacaaggctatgataaggatacgtagatagatcctcattgcccaaggatacaatctgcttacaaagcagatcaaacaatggacttttggaactgtaacagtagtttaaagcattaattgtagaaatttcttctaacgtatagttgggaatcccgtgttcctgaatatatcgaagatattggaaggtactatcaataacctgagaatagtgtttatcgcctttctccgtaagctcatagctaatatagaattctccagtatttaaagaacttctaaagaattccacgtctaaatccgtaattagctgctcgtttttcaataaagagactaaactgttcttactctcatttcttaaaacttcagcaagagccttgtaacagcctaaaggaatcggatgggaagattcataaatatgccagtaaatttctagattagaggtaggctgaattgcttggttaatatagagattctttaatgacgaggtgtcaccagaaggaagaaaaggttcctgtctttcataattttttgatctaggaatctgagaaaaaatctttgagaactgtttctttgctttagagagcggagctgatgtgtaagcaatagcacacatattctcaggagaataatgtagcttaaaccattctgccattttctctgtagtcactggggtgagggtggaagcattcccacaaccaaaacgtgcgcagggatggccctgaggagcaacaagctgctgaatgcgatgcacacgtctcccatcagaaagaggatgagcagcgaattcttgatgtactgcgtacttttctctatcaagatcttcttgacgaaacttcggattaataaatagatgaacaaattggtctaaagcatcagaaaacgcagaatgttctactgaaaatacaaagactgttttatttgggtaagtgaaagcattatgcaccccattattttcgcttaaaaatccagggaaaccagagacctcaggatacttttcatttccaagaaagacacagtgttctgtgaagtgcgccatcccaggatactcttcaggatcggcattatttcctgttttcacaaggagtgctgctcccgaagtaggaagattagggtcggaaataataagaagagggagcccgttactacaaataatcttttcaattttctggtccgcagcggcaggagtggaaacttgtaaagggcactgattggggacgactttgaactgctgttcacacgatgttatggatagggaagtgcaaattaaaataggacataaaagtttccaaaacatcttacaattcctcgtatagattttttacaatagaaaatactttttctgctcttaatgttctttgggcgtgtttatcgcaatgaataagttcctcttttgaacataatgcatcaaaaaatagttctgctccgaagttgaagaaaacaggagcaaagaaaatggctcgctgctccccaattgcattctctattttcggaggaggggggagaatgtcataggtttttaaagcaaagggataaaaatgtgtcgtttgattagaagccttagctaataaacgaaacacttcaatgctttctggagagaattctgaaggatataatcttccttccgcattttttctgtcacgacctcctgcaggggctacgtaaataaatttgcctccttcatttaacaaggtctttaatatttgcatgcttttctgattatgaagaagcttttcttcccggagttctggtggagtggcaatatgacgcttagaataaatacataataaatcacatcccatgctaaatggtcgtgctaggggatcagaagtgactcggtctccagctacaaaaatcatgttctccattaactcaggatgcgtcttgcctaaggcataatacatgagttgtggatcgcattctgtctggtgatttgcaaggagaacaacattatctcccctagcaatgtattcttctatttccttaaggcggtgtaggtttaaaattcgagagtttttatcgtcaatgactagagaaaaaaaatctatactcaaacgaaatagatctataggagctcgaatttttttatgatacggagggaaaatgaaagggtttttcaagtcctcgatgataaccttgacccattgtaaacatagcacctcagcttgatcagctgcagctttttttgtagctgcatcgatgtaattctgatgaaaaacagaaaatttctgatataaaggctctgggagatactggttatcaaaagcatagcgtaaatacctagaaaactgcatgtatattgccctataaatctatactttcccctgtaatgagagagaagaattggtagtggtttaaatgaaccgagtccgatgtattgatctgaagtttagcttttaattgcttagccaaattgatcatttcattgtcatcgttttcttgtttcatatagcttgcaatttctggatgcacaacaagacaaagatgagagtgttctttgtgattaataacctttttcaaatccctctcaatctcgatgaccacactttcaggtgttttaataatggcgttgccgctgcagtagggacatagagtgaataatgtctgcattagagattcccgatttctctgtctggtcatctcaacaagaccaaattcactcatgcttaaaatagtacagcgagcagcatcgtatttcatatgttctttcaatcgttccaaaacacgtcgctggttcttacgagatttcatatcgataaagtcaataatcactaatccgcctacattacgtaaacgcaactgtctggcaatttcttcagctgcttctaagttgatttggaccagagtttcttcaactccactttctaactgtgtgcttcttcccgaatttacgtcgatagtgtgcatggcttctgttttgtcaaaaaacaaataaccaccgctggacagccaaatttttcttcttgtcgccttatcaatttctttctctatattgaaacgctcaaacatcggaatagaatcccgataatactctatcttgatggaagcatccggagagtatttttttaacatatgtttgcacttttgatacgtagcataatcatcaataaggagtcgcttgtagttcttatcgatacaagtaatcacagctttttttagtatgtccgtctcagaataaagcaagcagggttgctctgtggaatagaatttttctaaaattgttttccaagtgagtaacaagtcgtgggcctcattaatgagagcttcagtagaggctgtagtgctcgctgtacggcaaatcaaacccatgtcttgaggcatttcaaaagaacgaatgagctgttttaactgctctctcatatggggatcttcaatttttcgagaaacacctcggtgaggtgagtttggtaaaagtaccaaataacgtcccggaatggagatgttagaagttaagcgagctcccttacttccaataggctctttgactacctgaacgagaacggggctgtctaatttgagaaattcttcaatgggagcttcctcagaagaaagaagaggagcttcagaagcttcttcgggaagagcatctacatccatatcgaacatctgttcaaacttcttcgaattctctaaaatatcagagatatgaatgaaaccattctctctctcatcaatattaataaacgcagattggatatttctcagaatgttggtaacacgacctcgataaatattgcctttgagctgacgaactttctttctctctatagttagatcaaaaagttgaccatttttcagatgggcatagcgaatttctttcgattctatgttgagtaaaatttcattttccatgactttccttgtgcctataccatatccttgagcttacttattctgtttgggaaaagagtggtttctagacgtcgaaacttaaatttctaactgctcgtgagataagttacgttggtgattataaagaaaataggtaaaaaattctacagaaatggctttttgattctttttaaaaataattaggttattttaatttaattcttttcaactgtaggtctttgttttctataatcattgtctttggtaagctatctttctaatcctcaaaaagccttggttctaggtagtaaaggttttagtatggactgtgtcgataatttaaaattatatatttttcgtttgaaactacctggagatacggaacgcatcagctattctattagccctgaatacattcgtgagaagggggaagaagagcttttgaattctcccatcgaggtggaagggtctctgggacgcatagatagtgaccaatggattctctcgctaagcctaaagactcagctaggtttatgttgcccagtgtgtaacaattttttttcacactccgtctgcttgccagatcttcaacgtgtgatatctcatgatgaggtaggttcgggagtctttgattgtagacctttgattcgtcaggagctccttttagaaagcgattgtttcgaagagtgtagtgggcagggctgccccgaaaggaaaaatatcttaaaatttttggaagacagaaaaaaacatgaggggaatagtccctttgagtatttataaaaggtaaggaacatggcggtaccacgcaatcgacatagtaatgcaagaaagaatattcgaagaagtcacgatgctaagaaggcttgtcacgcagcaaagtgcagcaattgtaagcatgcccttcttcctcatactatatgcccttcttgtggattttataacggtaaagccgttatgactgtagaaaagaaataaatcttatctgattttatggaagtgcaaattggcatagatttaatgggaggggaccattctcctcttgttgtttggcaagtgctggttgatgtacttaaatctcaaagttctactattccctttgcatttactctttttgcttccgaggagattcggaagcaaattcaagaagaatttatatcagatctgcctcaagagaagtttcctaagatcatttctgcggaaaattttgtggctatggaggactctcctctagcagctatccgcaaaaaatcctcatccatggctttaggattggattatcttcaggaagataaactcgacgcttttatatccacagggaatacaggggccttagttacattagcacgtgctaagattcctctatttcctgccgtatctcgtcccgcattacttgtttgtgttcctacaatgcgaggtcatgcagtcattctagatgttggtgccaatatttctgtaaagcctgaagaaatggtaggtttcgctcgtatgggacttgcctatcgtcagtgtcttggcgattctaagattcctacgatcggattgcttaatattggttcagaagaacgtaaaggtacggaagcccatcgccagacattccgtatgctgcgagagacatttggcgaagctttcttaggcaatatagaaagcggtgctgtctttgacggtgctgcagatatagttgtcaccgatgggtttacaggaaacatcttccttaagactgctgagggtgtatttgagttcttgcagcgtattctaggggataaacttgaagcagacattcaacgtcggttggattacacattttatcccggctctgtagtctgtggtctttctaaacttgtgatcaaatgtcatggtaaggcgtgcggttcttctttgttccatggcattttgggctctataaatctggctcaagcacgcctatgcaaacgcattttgtctaatttgatttagttaactacattcaattttttgcttctctgtatagctttttctttattgacgggatcttgttgatagtgctacatattttgcaaaatactttataaacacctctcaggtttaaggttgcaatggtagcgaaaaaaacagtacgatcttataggtcttcattttctcattccgtaatagtagcaatattgtcagcaggcattgcttttgaagcacattccttacacagctcagaactagatttaggtgtattcaataaacagtttgaggaacattctgctcatgttgaagaggctcaaacatctgttttaaagggatcagatcctgtaaatccctctcagaaagaatccgagaaggttttgtacactcaagtgcctcttacccaaggaagctctggagagagtttggatctcgccgatgctaatttcttagagcattttcagcatctttttgaagagactacagtatttggtatcgatcaaaagctggtttggtcagatttagatactaggaatttttcccaacccactcaagaacctgatacaagtaatgctgtaagtgagaaaatctcctcagataccaaagagaatagaaaagacctagagactgaagatccttcaaaaaaaagtggccttaaagaagtttcatcagatctccctaaaagtcctgaaactgcagtagcagctatttctgaagatcttgaaatctcagaaaacatttcagcaagagatcctcttcagggtttagcatttttttataaaaatacatcttctcagtctatctctgaaaaggattcttcatttcaaggaattatcttttctggttcaggagctaattcagggctaggttttgaaaatcttaaggcgccgaaatctggggctgcagtttattctgatcgagatattgtttttgaaaatcttgttaaaggattgagttttatatcttgtgaatctttagaagatggctctgccgcaggtgtaaacattgttgtgacccattgtggtgatgtaactctcactgattgtgccactggtttagaccttgaagctttacgtctggttaaagatttttctcgtggaggagctgttttcactgctcgcaaccatgaagtgcaaaataaccttgcaggtggaattctatccgttgtaggcaataaaggagctattgttgtagagaaaaatagtgctgagaagtccaatggaggagcttttgcttgcggaagttttgtttacagtaacaacgaaaacaccgccttgtggaaagaaaatcaagcattatcaggaggagccatatcctcagcaagtgatattgatattcaagggaactgtagcgctattgaattttcaggaaaccagtctctaattgctcttggagagcatatagggcttacagattttgtaggtggaggagctttagctgctcaagggacgcttaccttaagaaataatgcagtagtgcaatgtgttaaaaacacttctaaaacacatggtggagctattttagcaggtactgttgatctcaacgaaacaattagcgaagttgcctttaagcagaatacagcagctctaactggaggtgctttaagtgcaaatgataaggttataattgcaaataactttggagaaattctttttgagcaaaacgaagtgaggaatcacggaggagccatttattgtggatgtcgatctaatcctaagttagaacaaaaggattctggagagaacatcaatattattggaaactccggagctatcacttttttaaaaaataaggcttctgttttagaagtgatgacacaagctgaagattatgctggtggaggcgctttatgggggcataatgttcttctagattccaatagtgggaatattcaatttataggaaatataggtggaagtaccttctggataggagaatatgtcggtggtggtgcgattctctctactgatagagtgacaatttctaataactctggagatgttgtttttaaaggaaacaaaggccaatgtcttgctcaaaaatatgtagctcctcaagaaacagctcccgtggaatcagatgcttcatctacaaataaagacgagaagagccttaatgcttgtagtcatggagatcattatcctcctaaaactgtagaagaggaagtgccaccttcattgttagaagaacatcctgttgtttcttcgacagatattcgtggtggtggggccattctagctcaacatatctttattacagataatacaggaaatctgagattctctgggaaccttggtggtggtgaagagtcttctactgtcggtgatttagctatcgtaggaggaggtgctttgctttctactaatgaagttaatgtttgcagtaaccaaaatgttgttttttctgataacgtgacttcaaatggttgtgattcagggggagctattttagctaaaaaagtagatatctccgcgaaccactcggttgaatttgtctctaatggttcagggaaattcggtggtgccgtttgcgctttaaacgaatcagtaaacattacggacaatggctcggcagtatcattctctaaaaatagaacacgtcttggcggtgctggagttgcagctcctcaaggctctgtaacgatttgtggaaatcagggaaacatagcatttaaagagaactttgtttttggctctgaaaatcaaagatcaggtggaggagctatcattgctaactcttctgtaaatattcaggataacgcaggagatatcctatttgtaagtaactctacgggatcttatggaggtgctatttttgtaggatctttggttgcttctgaaggcagcaacccacgaacgcttacaattacaggcaacagtggggatatcctatttgctaaaaatagcacgcaaacagccgcttctttatcagaaaaagattcctttggtggaggggccatctatacacaaaacctcaaaattgtaaagaatgcagggaacgtttctttctatggcaacagagctcctagtggtgctggtgtccaaattgcagacggaggaactgtttgtttagaggcttttggaggagatatcttatttgaagggaatatcaattttgatgggagtttcaatgcgattcacttatgcgggaatgactcaaaaatcgtagagctttctgctgttcaagataaaaatattattttccaagatgcaattacttatgaagagaacacaattcgtggcttgccagataaagatgtcagtcctttaagtgccccttcattaatttttaactccaagccacaagatgacagcgctcaacatcatgaagggacgatacggttttctcgaggggtatctaaaattcctcagattgctgctatacaagagggaaccttagctttatcacaaaacgcagagctttggttggcaggacttaaacaggaaacaggaagttctatcgtattgtctgcgggatctattctccgtatttttgattcccaggttgatagcagtgcgcctcttcctacagaaaataaagaggagactcttgtttctgccggagttcaaattaacatgagctctcctacacccaataaagataaagctgtagatactccagtacttgcagatatcataagtattactgtagatttgtcttcatttgttcctgagcaagacggaactcttcctcttcctcctgaaattatcattcctaagggaacaaaattacattctaatgccatagatcttaagattatagatcctaccaatgtgggatatgaaaatcatgctcttctaagttctcataaagatattccattaatttctcttaagacagcggaaggaatgacagggacgcctacagcagatgcttctctatctaatataaaaatagatgtatctttaccttcgatcacaccagcaacgtatggtcacacaggagtttggtctgaaagtaaaatggaagatggaagacttgtagtcggttggcaacctacgggatataagttaaatcctgagaagcaaggggctctagttttgaataatctctggagtcattatacagatcttagagctcttaagcaggagatctttgctcatcatacgatagctcaaagaatggagttagatttctcgacaaatgtctggggatcaggattaggtgttgttgaagattgtcagaacatcggagagtttgatgggttcaaacatcatctcacagggtatgccctaggcttggatacacaactagttgaagacttcttaattggaggatgtttctcacagttctttggtaaaactgaaagccaatcctacaaagctaagaacgatgtgaagagttatatgggagctgcttatgcggggattttagcaggtccttggttaataaaaggagcttttgtttacggtaatataaacaacgatttgactacagattacggtactttaggtatttcaacaggttcatggataggaaaagggtttatcgcaggcacaagcattgattaccgctatattgtaaatcctcgacggtttatatcggcaatcgtatccacagtggttccttttgtagaagccgagtatgtccgtatagatcttccagaaattagcgaacagggtaaagaggttagaacgttccaaaaaactcgttttgagaatgtcgccattccttttggatttgctttagaacatgcttattcgcgtggctcacgtgctgaagtgaacagtgtacagcttgcttacgtctttgatgtatatcgtaagggacctgtctctttgattacactcaaggatgctgcttattcttggaagagttatggggtagatattccttgtaaagcttggaaggctcgcttgagcaataatacggaatggaattcatatttaagtacgtatttagcgtttaattatgaatggagagaagatctgatagcttatgacttcaatggtggtatccgtattattttctagttcgatgtgacagggcttcaatcaaaaaaaagggttacttttagtaacccttttttatttctcttaatgcttatagttcgatgatctttaatacatagagcaagtaggcgatacaagctttattaggttcataggtctctgggtccattaagagtgtagaaaagacctcggtatgagcggaagtttgaggaagccgtaaggatgcatataatatatctagagcaaactcacggattaaagctttggtttctggatctgctttttgcatggatttaaagacgctattaacaagttgatttccagaatttaaatacttatttaggaaaagagcagctgacaaatcagcgtcttctctgccttgatgtgtgtccactgtagtttgacgtaaagttagggcgccgagagtatcttgtaggtgttctgtaactagaccgagatttttcccatggaagaatttcatagtgttgatcacatgccattgtagtttggctgctgactcgtttcgtagaacttgttctattgcctctgtgtaacgctcaccgtgttgctgagccgcaaaccgatactcttcagcatcatcaccatcttggatggacatcagctctcgttctttaaactcttgaacccaaatcagaagctgattgtctccttcattagctatactatagagtctgttaagagatctggttatgacttctccccaagtcggcttacaagtcttgcaagaacttgcaataaataaggccgcttgcattttttcctttgtactaggagttttgggtaaagaggactttccagtaagagcttctatgaggagcttgatcaatattgggaacgtctttttatcaggattactatcatgttcgtttttcagtccctcaaagtacttcagcatgtgcttccattctggagttagcacgcctagagactttaatacttttttcagttgtgagcatagatccggaatcttccgcatggcttcttggctttcttgcggcgaaattgctactagtctatttaaaaagggattaggtaagggtgctttgcctacactttgttcaacaattttaaaagagcgaagtttgttatcctcaaaaagcaacgcttgcaaagcgaaaatgaagggttgaatgacctcattcgtttcttcagtagtaggttcacttaaatcctctacgatttttttagggggaagaggcatgaagagacgaagacctgctacgatgagattcaccggtaaaagaatgataaacagtactgaagtaataataaatgctaggatgttgagaatcacccaacataagggaccaccagagcacccgcagggattcagtattttttttgacatactgaataggctagaaggatgtaggacctgagccacgttggttaggcgtgtttgacacgcattttcttccaagataataagttccgtcctccgaggataaatcggcgaagtttttggaattaaattgtactttgctattaactctgcaggggaaaacaaagagatggggttagacatatgcatcttggagttatggattaagtagaaatattttattatactttctaagattgattgttattcaattaatttttatttagaaatactataaaaaagtagctcaaaacgaattgttttatacttatttatgagttcttaaagaacttgttttaagaaacctaaatattcatacagcgggaagtgtgtcaaaaattctttttaaaaactcttcagaagctatttgccctgtcgtcatcactttacataatttgcggcagtcctccttttgtttttctttagagccatgttgatttagcaaatctaaagcggtagcgatttcttctggatgaaaatcttttttccctccaatgaactctggaaaaatcacggagttcataatgatatttggtaaggaatacgcgggcaaaagaattttaaaaatatattttgctaagaatgtgtcaaaaggtcgaagtcgacacatgactattgtgggtgtttgatttaaggcagtttctaagactatagtgccacattttgctagtgcacaatcacagcttctcatgagctcatagcggaaattcatggggatgatttgactatgctgacatccttctgcttttagagtatcttcaatgatttcgtcgtacttagcgcttgatgaggaaaccacaaattgatgtgtttgagatagcgatgaatttagaaaagcttgtacctggatccgtaaatttcggctgatgtcaccacgacgacttccaggaaacgcagcaacaataggacggtcagaattaaggaatttctctttccaagaggcctgttctttgtagtcagagatctcctcaactagggggtgtcctaaatacacagtctcaagagatgtgtttttgaaaaggccttcttcaaaaggaaggatcagtaggagcatatcaagatgttgctctagtatgcgttttcttttggggcgccatgcccaaatactcgggcaaacgtaatggatgatttttcctcgatacccatgttttctcagctttttaattaagagaaggtgaaaatcggggaaatcaatgaagataagagtcgctggcttgtgtttgagtatcgtttttaggattttgcggtaatttcgatataatctaaataatgaccccagaacttcagcaaatcctgaaacttgaaactcctccatgtttagaatgggctggagaccttcttgtcgcattgcaggacctccaacaccccagaaccgtatgtttggatagagagactttatggattggattaacttaccccccaaaatgtcaccgctagcttctccagcagagagaaagcagtgtgtatccaaataaggagtcgaacgttgttctttataaaagagacgtaaatttgcgatggacgggaataatccacagccatagcacaggatgtttataggatctccgatgcgaatgaagtacaccagcgccagcaatcccccaagaagtccaattttccaaaatagtaaggggaaatctttagtattattcgattctatgtagaaccattggattaaaaaacgacccgaaaaaatagcaagccctaaacagcctataagatgccaagaaagttgtgcaggaggaagaggaagatggaagatattaggagaggccatccattccatgttcacatagaggaaaggcagagtcacgaacaccacgctcagagccatcagaactaaggtcgctcgaaaggaaatcggtcgagaggaagtaatatttaggtttctgaggtagataattaagttaatgacatgaagtacagtcacaggaaattggctttgaattgtcccgtggacaatcatcaaagtggctcctattgaagagagaatccaaaagcttcgaggagcatagacctctttgcgctttttactcagccaccactgtattgagaaggcactcccaaaaaaaagactagcaagaaatcctaggggataaagcagataaactaggccagaagggatcatgtttagacctacttttgagaatgagaatcctttttacacttaagtgtttgatgatgacgtatccaagcaacatacactttatcgagcttaggatacactatactacgaatttccaataaagataatgcttctaagaaccttgtgtgatgtaaaagtttcttattaaagaagagcgctttttttgtagggatcaggggagtgagtctgtactgcatttgtaaaattaatgctgtcaggataaaattcttttttgagcaacttgtgaacgagtcagcaaagaattgttctaggaaatttttgatataatcaaaaacggatgtcaaagacaaatacgggtgcttctgatgcttataacggacattaaagttcactaaaggaaaaaggaatatagccatcagctgatgacgatcatactctgcctctttttttagtattttgtcatctagagcttttaggtaggtggctgtttgctcttctagtgcgcgatttaagcggaatgccttatccatatagggaaaaaggatctcaagaagatggttctctattagcagttggaaaaagttctttgcggctccggaatttaacattttgataagttcttcgaagacccgtgcctgagaacttttaattagctcttggcgacaagcaattaaagcttcttgagtttgcgtttctacagtaaacggcgaccgtgataaaatctttaacagtctcagcatgcgtactggatcttgcttgaatcttgtaaagggatcgccgatagtgcgcaaataacggttccttaaatcattaacgccaccagtatagtctataatctcttcatgctcgggatcgtaaaacaatccattgattgtaaaatctcttcgcaagacatcttcttcaggagtcccccatagattatctttagtaatcaagacatcttcatcggtgcttcccgaacgaaatgttgaaacttcaataatctgcttagagaatctaatatgggcaagacggaaacgcttaccgaccaaaatacaatttttaaagatagctttaatttcttcaggtttcgctgaagtggagatatcaaaatccttcggcgtggtatttaataacaaatccctaatgcaacccccaacaatataagcgatataccctgctttacggagggttttgatcactgacagggcgtgaggagagaaatctttgagtttgatgttatggttagaaacagaatagatcgtaggagttaaagtgatattagattttttttttaacaattctaggcctctaccagagagaatattgttttcgcagaccattattatagttattaagagttaaaagtcttggaagaaaaagagtgtgtagtttgcgtctacttccattttaaaatcccaacatagcaaaactagggaagttttcaaggataaaaatgaaaaacaaaagatgttttctatagagattcctcttcaatttttaattatatatggatcattcttaagactctagcatccacagaacccggtagagagctcttaaatgccttgatcctggggagcagaaaggatgtaaaaagcatggaataaaaaatatctagtttctgacagaattcaattatagaactttacatccattggagagttctctatagaagatcgaagtattcttcgagaagagtactacagtcagaggctactttcttttacttatagtttactgcttataaattcgcttttatttgtgcgtgtagaagtgaaaagatacggagaataggaatagattttaggagaaacatgcaacaaagtgtcagaaaactttttggtacagatggtgtgcgaggacgagcaaattttgaacctatgacagtggaaacgactgttttattagggaaagctgtagctagagtacttcgtgagggtagatcgggcaaacatcgtgttgtagtaggcaaagatactaggctatcgggatatatgtttgagaacgcattgattgctgggctcaattctatggggatagaaactttggttcttggtcctatccctacgccaggagttgcgtttattacacgggcctatcgagcggacgcagggattatgatttctgcttcacataatccttacagggataatggaattaagattttctctttagaaggatttaaaatttctgatgttcttgagcagcgtattgaaaccatggtgagtgaagctgactttggtccattacccgaagatcacgcagttgggaagaacaaacgtgtgatagatgctatgggacgctatgtagagtttgtgaaagcaacatttcctaagggacgcactttaaaggggttaaagattgttctagactgcgctcacggagcttcttataaggtagcaccttctgtatttgaagagctggatgcagaggtcatttgttatggttgcgaacctacaggaatcaacatcaatgaacactgcggagctcttttccctcaagtcattcaaaaagctgtaatcgaacatcaagcacatcttgggattgcgctagatggggatggagatcggattatcatggtggatgagaaggggcatattgtcgatggagatatgatcctcagtatatgtgctggtgatcttaaaaaaagatccgcattacctcataaccgtgttgttgccacgattatgacaaatttcggagtcttgaaatatttggaaggattaggcctacaggtattcacctctccagtaggggaccgtcatgttttgcacgccatgttagaacatgaagtgaccttgggaggtgaacagagcggacatatgattttcttggactacaataccactggagatggaattgtctcagcgctacaagttttgcgcattatgatagaaagtgaatctatgctctcagatttgacagccccaattgtaaaaagtccccaaacattgatcaacgttgctgtaagagagaaaattcctcttgaaaccatccctttaattgaaagaaccttgagagatgttcaagatgccttaggcccctctggacgcatattattaagatattctggaaccgaaaatatatgcagagttatggttgaaggtcataaaaaacatcaagtagactgccttgccaaggctcttgcggatgttattgatgcagaattaggtacaggtagtagagagtaggatcgtatgtgcgggatatttggatatttgggaaaccaagatggtgtgtctattgttctagaaggcttggcaaagttagaatatcgtggttatgattccgcaggtcttgctgctgtagttgaacaagagctttttattagaaaaactgtaggtcgtgttcaagagctttcaaacttgtttcaagaaagagaaatccctacggcatcagttattggccatacccgttgggcaactcatggagtgcctaccgagattaatgctcatccacatgtggatgagggaaggtcgtgtgctgtagtccataatggaattatagaaaatttcaaagagttgcgacgcgagctgactgcgcaaggcatttcatttgcttcagataccgattcagaaattattgttcagctgttttctctatattatcaagagtcccaagatcttgtgttcagcttttgtcagactctagctcaactccgaggtagcgtagcctgcgctttgattcataaagatcatcctcatacgattctttgcgcttctcaagagagccctttaattcttggtttagggaaagaagagacgtttattgcttcagattcgcgagctttcttcaaatatactcgacattctcaagccttggcctccggagaatttgctatagtttctcaagggaaagaacctgaggtttataatttggagcttaagaaaatccataaggatgtacgacaaatcacctgtagtgaagatgcttcggataaaagtggctacggctattatatgctgaaggaaatctatgatcagccagaagttttagaaggtctgattcaaaaacatatggatgaagaaggacatattttatctgaatttttatcagatgttcctatcaagagttttaaagaaatcacgattgttgcttgcgggtcttcctatcatgctggttatctcgctaaatatattatagagtccttagtttcaactcctgtacatattgaagtggcttccgaatttcgctatcgacgtccctacataggtaaagatactttggggattttgatcagtcaatcaggagaaacagctgataccctagctgctttgaaggaattacgtcgcagaaacattgcttatctcctaggcatttgcaatgtcccggaatcagcaattgctcttggtgtggatcactgtctgtttttagaagcgggggtggaaatcggtgtagctacgacaaaggcttttacctcgcaactcttgttgcttgtgtttttgggtttgaaattagcaaatgtacatggtgccttgactcacgcagaacaatgttcctttggccagggattacaaagcttaccagatctctgtcaaaaacttcttgccaacgagtctctccattcttgggcgcagccttactcctatgaagataagtttctttttctaggccgtaggttgatgtatccggtggttatggaggctgccctcaaactcaaagaaattgcttatattgaagcgaatgcgtatcctggtggagaaatgaaacatgggcccatagctttaattagcaaaggtacccctgttattgcattttgcggtgatgatattgtctatgaaaagatgataggcaacatgatggaggttaaagctcgtcatgctcatgtgattgctattgctcctgaatctcgtgaagatatcgctgcagtttctgatcaacagatctttgtcccagattgtcattttctcgctgctcctgtgttatatactatagttggtcaagtgatggcatatgctatggcgttagcaaaaggaatggagattgactgtcccagaaatcttgccaagtctgttactgtagagtaagtacttcacagtagtagacctcgcaatcctatgatgaaactctttagaacttgtcttaagagtgcatatgaaatttaggtatacgttatgtcaaataaagttctaggtgggtccttgcttattgcaggttctgccatcggtgctggtgttttagcagttcctgtattgaccgcaaaaggcggttttttccctgcaacttttctctatattgtctcctggcttttttctatggcctcaggcctttgccttcttgaagtcatgacttggatgaaagaatcaaagaacccagtgaacatgctttctatggcggaatctattttaggtcatgtaggcaagatttctatatgccttgtctacttgtttctcttttactccctactgattgcctatttctgcgaagggggaaacatcttatgccgcgtgtttaattgtcaaaatttaggaatctcgtggattcgtcaccttggccctctaggttttgctatattgatggggcctatcattatggcgggaacaaaagtgattgattactgtaatcgtttctttatgttcggcttaactgtagcttttggaattttctgtgcccttggatttttaaaaatccaacctagctttctggtgcgttcctcatggttaactacaataaacgcatttcctgtgtttttccttgcttttggattccaaagtatcattcctacgttgtactactacatggacaaaaaagttggagatgttaaaaaggcaattctcataggaacgttgattcctcttgttctctatgtcttatgggaagttgtggttttaggtgctgtctctcttccgattctttcccaggctaagataggtggatatactgctgtagaagctctcaagcaggcccatcgttcttgggcattttatattgctggagaactttttggcttctttgctttggtctcctcttttgtaggagttgctctcggtgttatggacttcctggcagacggtttaaaatggaataaaaaatcacatccattttcaattttctttttaacatttattattccccttgcttgggctgtttgttatcctgaaattgttttaacctgtcttaagtatgctgggggattcggggccgccgtgattatcggggtattcccaacattgattgtgtggaaagggcgttatggcaaacaacatcacagagagaaacagttagttccaggaggaaagtttgctttatttttgatgttcttgttgatagtaataaatgtagttagcatttatcatgagctttaaatttattttgctctatttttcaatttcaagtgagcaaataggagggttctatgggactatatgatcgtgactatatacaagattctcgagtgcagggaacttttgcttcaagagtctatgggtggatgacagcagggctaatcgtaacttcatgtgttgccctgggtctttatttttctggattatacagaagtttattttctttttggtggatgtggtgtttcgctacgctaggcgtgtctttctttatcaactctaaaatccagacactatcggtagttggtcaagtgatggcatatgctatggtgttagcaaaaggaatggagattgactgtcccagaaatcttgccaagtctgttactgtagagtaagtacttcacagtagtagacctcgcaatcctatgatgaaactctttagaacttgtcttaagagtgcatatgaaatttaggtatacgttatgtcaaataaagttctaggtgggtccttgcttattgcaggttctgccatcggtgctggtgttttagcagttcctgtattgaccgcaaaaggcggttttttccctgcaacttttctctatattgtctcctggcttttttctatggcctcaggcctttgccttcttgaagtcatgacttggatgaaagaatcaaagaacccagtgaacatgctttctatggcggaatctattttaggtcatgtaggcaagatttctatatgccttgtctacttgtttctcttttactccctactgattgcctatttctgcgaagggggaaacatcttatgccgcgtgtttaattgtcaaaatttaggaatctcatggattcgtcaccttggccctctaggttttgctatattgatggggcctatcattatggcgggaacaaaagtgattgattactgtaatcgtttctttatgttcggcttaactgtagcttttggaattttctgtgcccttggatttttaaaaatccaacctagctttctggtgcgttcctcatggttaactacaataaacgcatttcctgtgtttttccttgcttttggattccaaagtatcattcctacgttgtactactacatggacaaaaaagttggagatgttaaaaaggcaattctcataggaacgttgattcctcttgttctctatgtcttatgggaagttgtggttttaggtgctgtctctcttccgattctttcccaggctaagataggtggatatactgctgtagaagctctcaagcaggcccatcgttcttgggcattttatattgctggagaactttttggcttctttgctttagtctcctcttttgtaggagttgctctcggtgttatggacttcctggcagacggtttaaaatggaataaaaaatcacatccattttcaattttctttttaacatttattattccccttgcttgggctgtttgttatcctgaaattgttttgacctgtcttaagtatgctgggggattcggggccgccgtgattatcggggtattcccaacattgattgtgtggaaagggcgttatggcaaacaacatcacagagagaaacagttagttccaggaggaaagtttgctttatttttgatgttcttgttgatagtaataaatgtagttagcatttatcatgagctttaaatttgttttgctctatttttcaatttcaagtgagcaaataggagggttctatgggactatatgatcgtgactatatacaagattctcgagtgcagggaacttttgcttcaagagtctatgggtggatgacagcagggctaatcgtaacttcatgtgttgccctgggtctttatttttctggattatacagaagtttattttctttttggtgggtgtggtgtttcgctacgctaggcgtgtctttctttatcaactctaaaatccagacactatcggtttctgctgtagggggccttttccttctctactcaacattagaaggaatgttttttggaaccttacttcctgtctacgctgctcaatatggcggaggggtgatctgggccgcttttggatcagcagccttggtatttggcttagcagcagtatacggagcgtttacaaaaagcgatcttactaaaattagtaagattatgacttttgctttgataggacttctgctagtgactctagtctttgctgtggtttcgatgtttgtatctatgcctttaatctacttattgatttgctatctagggctcgtcatctttgttggattgacagctgctgatgcgcaagcaattcgtcggatttcttctactataggggataacaataccttgagttacaaactctctttgatgtttgctcttaagatgtattgcaatgtcatcatggtattttggtatctgctgcagattttctcatcttcaggaaaccgagactaaacaacgacttagatcttttctacttcaggaaataatttgtttagaaaaagatctaagtcgaattcattaagatcctttaaagattccccataaccaataaactttgtggggattttcagtcgtttagctatttgaaatagggtgccacccttggcagagccgtctacttttgtgaagataagaccagaaaggggaacaacatcatgaaatacccgcacctgctctatagcattattccctaaggtagagtccacagtcataaaaatttcatgaggagctccctctagagctttgccgcaaaccgagactattttggaaagctctttcataagattgccatgtacatgcaggcgacctgaggtatcaataatgactctagagtacccccgggcgattgcagattgaatcccatcaaaggcaatagcagcagcgtcccccccgggttgtccagagacaaagccacagccaagttcgttggcccagagtcgtgcctggtccatgccagcagctcgaaaggtatccgtggctacaagcatgacgctttcagatcgctctttgtagtaatgagcaagtttggccgctgttgtcgtttttcctgagccgttggtcccaagaagtaaagaaacaatcggtctggtctgggaactttgtgaagcttgagaaggaagaccttctagagactcgcgaagtaaaactgtaatcagatctttgatagtagatgcgtcagcttttttagtccgacgtaatcgtgcacacaattcttcagtaagctcagtaccaaaatctgcttcataaaacaaactttcagcatcttctataagatctaaagatatattttttttaaataaagattgaagcttgtttctaaagaatttgaacattgctaatagcaaagttagttgaagtaaaagaaatgatacaagataagaaggaaaaagcaaagagttatttatgcatcttcatgagtaccaagctaaagatctcttagcttcttacgatgtgcctattcccccctattgggtagtgtcttcagaggaagaaggggaacttcttatcacaaagtcgggattagattccgccgtggttaaagtacaggttcatgctggaggtcgagggaaacatggtggtgtcattgttgcaaaatcctcagcaggcattttgcaagccgtagctaagctcttaggaatgcattttactagtaatcaaactgccgacggatttctccccgtagagaaagtcttgatttcaccacttgttgctatacaaagggaatattatgtcgcagtgattatggatcgaaaacaccgatgcccagttcttatgctttcaaaagcaggaggtatggatatcgaagaggtcgcacactcttccccagaacagatcctgacattaccactgacctcttatgggcatatctatagttatcaacttcgtcaagccactaagttcatggagtgggaaggagaagtgatgcaccaaggtgtccaattgatcaaaaagcttgcgaagtgcttttatgaaaatgatgtctctttattagagatcaatcctttggtgttgactttagagggtgagctacttgtcctcgattctaagattacgatcgatgacaatgccctataccgtcatcccaacttagaagtattgtatgacccctctcaagagaatgttcgggatgtcctagcaaagcaaatcggattgtcctacatcgctctaagcggaaatatcggttgcattgtgaatggcgccggacttgccatgagtaccttagatattttaaagctccatggtgggaatgctgcgaatttcttagatgtcggaggaggggcttctcaaaagcaaatccaagaagctgtatctttagtattgtccgatgagagcgtgaaagtgctttttatcaatatcttcggggggattatggactgttctgtagttgcctccgggctcgttgcagttatggaaacaagagatcaagtggttcctacagtcattcgtctcgaaggaacaaatgtagaattgggaaaagaaattgttcagcaatctgggattccttgccaatttgtctcttctatggaagagggcgctagacgcgctgtagaactgagtatgtagatttaggagatacatgttccactcactaagtaaaaatactcccatcatcacacagggaattacagggaaagcaggttcatttcatactgagcagtgcctcgcctacggtacgaatttcgtagggggtgtgactccaggcaaagggggaaccctttggctagacctgccagtctatgattctgtacttgaggcgaagcaagctacagggtgtcgcgcgaccatgatttttgttccaccaccttatgccgccgaggccatcctagaagccgaagaggccggaatcgaacttattgtttgtattaccgaagggatccctgttcgagatatgcttgaagtggctagagttatggacaacagtacttcacagcttatcggcccgaattgtccaggaattatcaagcctggagaatgtaaaattggaattatgccaggatatatccacctgccgggaaatattggagtggtctctagatcaggaactctgacatacgaggctgtttggcagctcactcagctcaaaatcggccagagtatttgtgtaggtattgggggagaccccctcaatggaacctcatttattgatgtcttgcaggcgctggaggaggatccctatacagaactgattttaatgatcggggaaatcggcggtagtgccgaagaagaggccgcggcctggatccaagcacactgcacaaaacccgtggttgcttttattgctggtgttacagctccaaaagggaaacgcatggggcatgctggggccatcatctctggaaattctggggatgccaaaagtaaaatacaagttctacgtgaatctggagttactgtagttgagtctccggcccatatcggaaaaactgtagacgctgtattacgggcaaaagaactctaatgcttaatcatctaacctacaagtacaaggttcgcttaatcctttggattgggagctctctactttaatgaagatcttgtgcttggggactcattcttgcgcctagttcttattcatgtcttacgtcgctatttccctgtgggtaaggaaaatcagaaaaagagacctattcgcaagttataaagtatttacttgaaatattatttccctcatctactagctctttaagaactagccaagggtggatagaagtgccttcaaggagtgctctggcagccatatctaagtgtgtgttcaaaccctattctggcaacacaaataagatagatgttgtgggatactatatcataagagtatactgtttccaatttcttcaaatccgtaagcttttttctttccttacacacgactttattttttgaaatatcttatcaataccttagaacgaagttctaattaaaataaaatcaggatgttatgcaggtctacgagttctctcgtcaagttcaacccacatttcaaaatttactcatggaaaaattagatgcctgctttttctttggaggaaagcgggtaaaaattatcggtttagatgaacctaatctggcttgaggaatagaagaacaggttgcactatccattgctataaagatccttaaaattatccttgcacttattttgttcccattagttttactcgcctgggtgattcgctatcaattgcacgcaaatttccattgtagtgtagtgcccttcccaggattttcggtaaaccaagcatacaaatgtagtgaggctaagatagaagaaatgctagatcttctagacttagaaaccctggaatggtcatcaagatgccttcgtcaagatatgacatttgcaaatcggctagaggaagagctgattcaagaacttcgtgtgtcagagaccgaggagttgattagtcttggtggtaaacgaaaccttgtgcgtttacttctcacgcacttttttaatcctccaaagagatcgcgtgtagagtctgtaggtcatgaggttgtctttcctgtatttgataggctaaagagagaagaggaaatcattggggatggacccatcactcgatccaatgaggaactgtgggctcttctagatcatggaactgctcgcgggatccataagaccctttggttttcgattttttttaagtatctaacacaaatcgaactgttctagaagcaggtattggaggggagattttcaagagacttaacgctatattccagacttctaccggtcaaacattgactttagctccgaagctctcgaatctttgcttttctgttcatttctctgggttgctgcgttgggaaaacattcaagttgagtagagagaaattgttaattttgtttcttttcaaagattttatcttaccagtctcttctatttgtctgagttacttgagtgatgcgtgattttttacatgtgacttttggatcatggataactggaacttttataaaagatatcgagttcagaaaagaagaaaaaaacctcttttatttaatgatttattttttaaagtatataaataatttataattataaaataatttactttttaataattaaaatgtaaactgtttgcactttaataataattataattatagattttgatgcttgtctattgttttgatccctcggtaccaacttcaccagaacaccgcctgatggcggcattagaccgttggtttttcttaggaggacatcgtgcaagaattctcacgcttgagggtaatcactatcgggcttttcaagaaaatatgtctatctcaacagtagagaagatattgaaactaatttcctatctactcatccctattgtccttattgctttgctaatccgttgtttcttacactctaggtttaaatgtaattggaaatgcgattctctaagtgacgcaagagtcccccacgacgttcaacctttcaatgatttccaacttttcaataatcaggagaggctaaatatatggaaaaatcggagatatgtctctggaatagatgtgcttatggtgccggtcgattatctcagatctcagtttcccggttttaaggagattccagaagctatccgttgcgaaaactatgtaagtgatggtcagttttctgaagaaagtaaaacaagctatcttagagcgatgctgaccgacattgttgggtatatcttgtcattagatgagacctattggacgaatgtgatcctcaagatccgtgcgatgtgcatcaccttcgaaagtttccctggaaaagaagcagaccctaactattcccctcgcgtaactcaccactattttgatgaatcttggaaggcacttgcgcgacatgtattaggagaaggtaacatggtgaatagactagatgaggcgctaattcgtacagagaagccgggcaaagaaggggaatgtattacgaaacagtttttaaaagattactgtaaaaagcatctcgaagttatgagttgtccagatttcattgaatctctggtagatgaaaaaatccgagagtttcgttgtccaagtattttaaactcagcagtatgtgatgtaatagatcgcaaatgccaagaacatttgttaaaggcaataataaacgaagcaaaccgcaggctccctgggatgaaaaatagctcattcactatgcgtggtaaccaagttttattttataccatcttttctccaccaaaattgccacctgctgcgagttccgtatatttttaaagaaaggagatctcttggtctcctagtcctgctataaggtcttgatatacatctttttggagtaatttcattttttatattattttattaaaatctttataattcgtttcttttgaaatatttattgtatttcttaataactgtatataaaccaatttgctaatattttaaaaagtagttttttgatggaagtttatagtttttccccttcagtaagaacttcgtttcagcaccgtgtaatggcggcactagataattggttttttctaggagggcgccgtttaaaagtagtttctctagatagttgtaactcagggcaggcttgtgaagaatacgtgcctatttcaacgacagaaaaggtcttaaagatactctcttacctactcataccgattgtcataatagctctgttaattcgttatcttttgcatagcaattttacggcaaaggtatcacagaaaccttggttaaagaccctgcagttaggaattgatataaaaagcttcatacttcccggttctcatgtaaacacgatggattcagctactttgtttaaagcaattcgtttggaagggaagcgtgttgatgtagaatatcataggctacatagcagcgataaggtggttttttatatccctgctcagaaacttccagatgatctgcgtttgactcattggcttccagaaaaagaaacaagaaagactgagtatgtgagacatatgctggcccatgtcatgggttatctaacatcacagggtaaggaacggcttcaacaggtagtgcaagactctcgaagcagtacttccttgggggctgaaaaagtccttcaatacagattcattgatcatccacagagtcaaggagaatttcaacgtctgcttaatgaaaatataacgaccaaaggttccgaggataaggaagttgtacagagtgatttatttgacatggcttttcagtgttggtggccacagtttatttcagttatacaatctccgaccttcagtgaagaattagtacacgaaatgagtcagaaacttgatttagattgtatatacccagaagatgatgaatttgagcagaagttccttaatacccttctgaaagcagtcttgcaccacggttttgaaggaatcagtgttgcgagtatgggtgttatcttcctgatttgtccggactctcttgcattacagattcccttcttaaggaatcaaaaatgatgcaggtgtcgaggttcttagttttaaggtagtaagacctccccgcggtagaatataggatcttcaagctcaaagtctccggctttgagcgatgttcccctcaaactttaattctacatcatgaagtattctcaatctaaagataaaaaatccttttgtagtgctgtgttagttacatatgatttgtttttttaatatgcattgtatttttcaataaataatgataaacgcttcgcgaatgttttgaaaatatttttttatggaagtttatagttttcaccctgcggtaaggacttcgtttcagcaccgtgtaatggcagcactagatgcttggttttttctaggagggcaccgtttaaaagtagtttctctagatagttgtaactcaggttgggcgtatcaagaacttgtgtctatttcaacgacagaaaaagtcttgaaactactctcttacctactcgtaccgattgtcataatagctctgttaattcgttgtcttttacatagcaattttaggatagacgtagagaaggaacgttggttaaaaataagggagttaggaattgatatagaaagctgcaaactccccagttcttatgtaaaccaggtttcctcgtttatttggtttgaaaaagataaatccaaacggccacgtattgatgtagattatcatacgctacatagcaaagactgggtagttttccctatcgtttttcagaaaattccaaagacctcgcgtttcagttattggttctcacaaaaagaaacaaggaagagggattatgtgagaaatatgctggaccacgtcattggttatctaacgtcagaaggtggggagtggttgcagtatatatcgaaaacctcttatcaaagcgctacttccttggatcctgaaagagttcttcaatattgcttaactgataaccaggagctccagggagaagtgcaacgtttgcttaatgaggagagtgcgaccaaaagctctggggataaggaagttttgttaagtcatgtatctgacattatttgccagtgttggtggccaaagtttcttgaagttatacaatctccggcctttattgaagaattagtagaagaagtgagtggtaaacttaatttagattttttatgcctagaaaaggctaatacattagatcaggagttgagaaacagtcttctaagagcagtcgtacaccacggttctgaaggagttgatattaagaaagttggtgccggcctcattatttatacggaagctattcaattacagattcccttctcaaggagttaaaaatgatcgtagtgtcggggtgcttagttttaaggtaacaagacatcctcgcagtagaagagaggatcttcaagctcaaagtctccggatttgagcgatgtttccctcaaactttaattctacatcatgaagtattctcaatctaaagatataaaatccctttgtagtaatgttttcgtcacatatgatttgtttttcgtaattactaggtagcagaacctgtgttagctagtatacgatggtattctgcttcatcgaaagacaaccttcttgagggatagatatgataactaagcaattgcgttcgtggctagctgtacttgttggttcaagtctgctagctcttcctttatcagggcaagctgtcgggaaaaaagaatctcgagtttccgagctgcctcaagacgttcttcttaaagagatctcgggagggttttctaaggtcgctaccaaggcgactcccgctgttgtgtacatagaaagtttcccaaagagccaggctgtaacacatccttctcctggacgccgtgggccttatgaaaatccttttgattattttaatgatgagtttttcaatcgtttttttggtctaccttcacagagggaaaaacctcaaagtaaagaggcggttcgaggaacaggtttcctagtatctccagatggctatattgtgactaataaccatgttgtcgaagatacaggtaagattcacgtaactcttcatgatgggcaaaagtacccagcaactgtaatcggactcgatcctaaaacagaccttgcagtcattaaaattaaatcccaaaacctcccgtatctttcttttggaaactccgaccacttaaaagtcggagattgggcaattgcaattggaaatcccttcggtcttcaagctacggtcaccgtaggtgtcatcagtgctaaaggaagaaatcaactccacattgcagattttgaagattttattcagacagatgctgcgattaatccaggcaactctggaggccctcttctaaatattgatggacaggtcatcggtgttaatactgccattgtcagtggtagtggtggctatattggaatcgggtttgcgattcctagccttatggcaaatagaatcatagatcagctgattcgtgatggtcaagttacccgaggattcttaggagtgactttacaacctatagatgcggaactcgctgcttgctacaaactcgaaaaggtttatggcgctttagtcacagatgttgttaaaggatctccagcagataaagcagggctaaaacaagaagatgtgatcattgcttataatgggaaagaagtcgattcactgagtatgttccgtaatgctgtttctttaatgaatccagatacacgtattgttctaaaggtagttcgtgaaggaaaggttatcgaaatacccgtgacagtttctcaagctccaaaagaagatggaatgtcggctttacagcgtgtgggaatccgtgtgcaaaacctaactcctgaaactgctaagaagctgggaattgctccagagactaaaggcattttgattataagtgttgaaccagggtctgtagcagcttcttcaggaattgctcctggtcagctgatccttgctgtgaatagacaaaaagtatcttcgattgaagatctgaatagaacgttaaaagattctaacaatgagaatattcttcttatggtttctcaaggagatgttattcgcttcattgccctgaaacctgaagaataaaaagcttggagtcatacatttgattcataaagaggaatgaagagagttctctcttcactcttttattttaggaagcttatcaagaagctgacaaatagaaaggaatccctttttaagttggtccatcgagaaatgctcttctgcagcgtgaatatcatcactaagatacgaagtcccacaaatgataggtgaggtttgtgctgcttcccctaataggggacctatcgggatcgtagcaggcatcactaatctcaggcattcttcattgtagaggtcactatagatctcttgaagcactttgactattgggaggttcgcagaacttctccaacctcgagatcctcctggaagaatttcataagagaactttaacgaagaagggacttgttgtttcaagtgatggataacttggtgagcagctttatcaggatcttgattaggaacaagtcggcaggagaggtaggcagtggctctataggggatcacagtcttaaatcctggtcccgtataacctccagaaattccattgatttctacagtaggacgtaacgcagattcttcagggctataagaagcttcgtaaccctgaggtcgaaaccctaagttttcttcgcattcccgaagggtatccgacttcggaagatcaggacgatcgctatccgaggggagagcaagatcatcataaaatccttcaatagctatagaattgtcagggtgatgcagagagctcagaatttctgataaagcacgattcgtattgtaggcaattcctcctaaaactcctgagtgcatgtccttgttcccctcttcaagggagattttcatggaaacaataccccgagctccaatgcttacgtaggggtgtttttcagaaaggaaacccccatctacgatcagaagatagtccgcgcgtaaagcttcttttttcttttctaaccaagtaaataatgcgagactcccactctcttcttcaccctcaattaaccaaataatatttagagggaagtttccttgagattcgtaatagtgctgtaatgcctttaaggtgtaaaaacattgtcctttgttatcagaggctcctcgggcatagagattgccattctcttctctaaggataaagggatctcccttccaaccatcagatagctgtgctggctgcacatcatagtggttatagagcataagagtagggctaagaggatcttcgcttttataggatgcatagatgatagggggatgcccaggcgtttcccagagctctacatcgaaaatcttattcacatgatctactaaaaaatgtgcacaattttcacaatcctgaagatgatcactatccgcagatatcgaggggaagcttataaattttgcaaactcttccaggaaatttgcactatttatatcaaaatgtttcgaatctagattcataggtttcccagagcagttgttgaaaataatatcacagtaacttaacttgtcttttgtcgaaaagaaaataagaacatagggtttagcgtgctttttagcatgattaagcatgacaaattagggattcagccctaactaatcagatgagttacagaaagtatgaaagctggtgatacgtatagaaatttcattattaagtcatgcaaagatcttcctgaaatagaaagtaagctccttgaggcggaacataagccgacaggagcttctattatgatgatcgtcaacaacgatgaggaaaacgtattcaatatttgctttagaacatgcccacaaacttctaacggtgttgcgcatgttctagagcatatggtcctttgtggttccgagaactaccccgtgcgggatcccttcttttcgatgacacgtcgtagtctgaataccttcatcaacgcgtttacaggtccagattttacatgctatcctgcagcttctcagattcctgaagatttttataatttactcagcgtgtatattgacgccgtgtttcatcctttgcttaccaagcaaagtttccttcaagaggcatggagatacgaattcaattccgagaatcatctctgttatacaggagtagttttcaatgagatgaaaggtgcgatgatgtcgggagaggcacggctctctgaggctctaaatgcagctattttcccttctgtgacctacggcgtaaactcaggaggagaacccagagagattgtaactctatctcatgaagacgtccgagcattccatcaaagccagtatagtatcaatcgatgcttgttttacttttatggaaatatcaaaccttcccgtcatttagatttcttggaagaaaagctactcagacaagctacaaagctagaaaagcaggcagtatccgtacctttgcaaaagcggtttaaggaaccagtaaggaacatcttaacgtatcctgtcgatcatcaagaagaagataaggtccttttcggaatttcttggcttacctgttccattttagaacaacaagaacttcttgcgctgcatgtgttagaaattatcctcatgggtacagatgcctctcctttaaaatctcgattgctgaaatcagggttctgtaagcagacagaaatgagcatcgagaatgatatccgtgaaatccccatgaccttggtatgtaaaggatgttctccagcaggagcccagaaattagaagctttgattttcgcttctcttgaagaaatcatccgcgaagggatatcagaaaatattgtagagggagcagttcatcagttagagttatctagaaaagagatcacaggatattctctaccctacgggctgtctctatttttccgctccggactattgaaacagcacggaggctctgccgaagatggcctgagaatccatagcctcttttctgagctccgtaattcgttaaaaaattctgattatcttgccaagttgatccgcaagtacttcttagataatccacattttgcaagagtgattttacttcctgataccgaacttgttgctaaggacaataaagatgagcagcagcttttactcagtgttagtgaaaaactcacagacgagaataaagaaaaaattcaacaaaatgtacgagaactcacagaatctcaagaacaaaaggaagatctgaatggtattcttcctaaccttgctttggataaagtgcccacgtctgggaaggaatttcctttaattaaagaggggctgagtcaaggagaagttcttcatcacgaatgcttcacgaatgatattgtcttcatagatgttgtcttagatatccctccgctatctggagaagaacttccttggttgcgtttgctcgtatttttaatgttgcagctgggatgtggaggcaggtcttataaagaacatttagagtttttgttagaacatacaggtggcgtggacgtctcttatgatttctctcctcatgcaaataaaaatagtttcctctctccatcggtaagtatccgaggcaaagctctgtcatcgaaatctgagaagctctgtggtattgtcagcgatatgttaacaagcgtggatttcacggatattcctaggattcgtgagttgctgatgcagcataacgaagccttgaccaatagtgtgagaaatagtcccatgagctatgcagtgagcatggcctgctctgggaattctataacaggggcgatgtcttacttgactacagggcttccctatgtgaaaaaaattcgcgaactcacaaaaaactttgatcagaatatagacgaagcggttgtcatcctacaacgattatacaccaagtgtttctcagggaaacggcaaattgtcattagtggaagcgctcataactatcagcaattaaaagataataagttttacggtcttttagactacctgattgtgattcccgaaccttgggaaaatccaagtataaacttatatgtaacctctcgggggttgcatattcctgcacgtgcagcattcaatgctcttgctttccctattggcgatatagcttatgaccatcctgatgctgcagctctaacagtagcagcagagatcttagataatgtggtcttgcatactaagattcgagagcaaggaggagcctatggctcgggagcagctgcaaacctatcacgaggatctttctattgctatagttatcgagatccagaaattgcaactacctacaaaacgtttctaaagggagtgtcagagattgcttctggtaatttcactaaagaagatatctatgaaggagctcttggagttgtccaaggtttggatatgcccgtagcgccaggaagccgtgcttccgtagcgttttataggctaaaaagtggtaggattcccgtgttgcgccaagcattccgccgttctgtccttgaagtgactaaagaacacatttgtatggttatggataaatatctagagtcaacagttcaggagacaactttgatatcttttgcaggggaagagatgcttcgtaataatgttcttactctagataaagatttccccatagtaccagcaatttgagacttagtcttgtttttctaaagactcaataacagctaagttcgtatctatatcacatgtgtgtggaaacgaggtggctaagctttctataggggtaggctcttcaatctgatgggatgacgaggtttccaagccttcgaacttccttaatgtaggcagtacccggtattgaaagctagaggtcatatcgttgtaactttgtaccgtctggtttaaatttttgcctatcttctgaaaatgtgtgaacactacctgtaggcgacgatggagctctttacctaaaagactgacctcttgaatttgtttttgcagattctcttgcttccacatgtaagcaatcgtcttaagtagagcaagtaaagtcaaaggactggataagattacgtttgaagaagctccaatctccatcaattcaggagctaaccgaattgcatcattgaataagctctccccaggaagaaaaagaatcacgtattctggtgattgatgaaacttttcccagtaactcttggatttcagagtcttaatgtgctctttaattttatcaacaagatcccccttgtcaatctcctctacagaaaaataggagtctgaaatcggagctttagcatcaataattaaacagcgatcttgaggcagccgaataataatatccgcccgaaatgctccttgggcacttgtggtttgactgtcgtagtcacagtattttaacatcccggcaagctctaaaattctctccagttggatttctccccaacgtcctcgagatcctgggtgctttaaaatgtccgtgagaacatgagtttcatgctccaattttttctctacagcaagtaattgcgatatctgttcttttaaccttccacgatcttcggcatgcttagtttcaaatgtctctaaactttgcttaaatgtcgtgagtgtcgtttggataggagaaagtatagactgaaaagatttagacgtatcaccaaaataattctgagcctcttctttcatatctttgatgagtttgtgagaagaaagtgctagacgattgctgaaatcttcaattaactgctcttgatggcggctaagatttaaagaagtctgtagcagttggttttcatgttctaatttctgaatcttctctagaaacgcacgcttcttccttgcatagagagaagacgatacgaagactcccagaaaaaacacacacccagataaaagtaggcacgctagggaaacagggaggttcataacagatgctagctcttttttctatagatgattgaaaagatcggaaagcctactaaagtatatagccaagatacaaggaaaaagacttcaacaaaatgatctacaagtcctgaaaagaaaagacatgctgctaaacctatagtcactaccagcagaaaagaagaaacattaaagcggaaatgcttcactccaggaaatttccatggagaaatcatcagacccccaatgaaaagaagggcaaatgataatagacctacccgaagttgggcagggaggtctggaaagaaatccgaagcaagaaataaagctaaggagacaatacttgcagcagcagcaggaatgggcagaccaataaaacaataaggctttgaaacatctacagtcttttgagaaaagaggttgtaacgtaccaaccgcaacactccacacagagaataaataatcgaggtgatgagtagtagcgaagagaaaaaattcccaacataaatcccatcaagactttttatagcaatcaaaggtggggcaatgccgaaagtgaccgcatcagaaagagaatcaaactgagcaccaaaagcgctctcggctttcatgattcgagcgatcgcaccatcagaaaaatccgcgatcatagcactaataagcaagagagataagccctgcaaacgatggaataactctacagaggacgacgttcttaatacgcttttgaaaataataaataatccacaacaaagtccaaaagcagtaatagcgttaggtgtcactacgcgacgcttgcctcgtgcttctagatctaatcccgccatgtcaatttgccagagtttcttttgctcgtagcataatggattcttctaaaatcaacaagtttttgcagtcctcttgtctattaagatctctatctccaaaagctcctagagtatgatatttttaccgagaaagggagcatttttcaattgcaggaaaccatgacaattcctatatatggtagataagcgcataacgtttcactacatattgggttttttaaagaaaaatccttcttatgtttaaaggcgtttttctttctactttttaattataacaaaggaaaaagtactccaatatttatggttttggagtcctgattttctagtgcgcaaagaataaaagaatctaatatttaaatatcattttagggaaaagttatggtcgaagttgaagaaaagcattacaccatcgtcaaacgtaatggaatgtttgtcccatttaatcaagatcggattttccaggctttggaggcagcttttcgagatacgcgtagcttagaaactagttctccactacctaaagacttagaagaatctattgcgcaaattactcataaagtcgtgaaggaagtcctcgctaaaatttcagaaggtcaggtagtcactgtagagagaatccaggatcttgtagaaagtcagctctatattagcgggttgcaggatgtggctcgcgattatattgtttacagggaccaacgcaaggcagagcgcggtaactcttcgtccataattgccatcatacgtagagacgggggaagcgctaaatttaatcctatgaagatctctgcagctctcgaaaaagcattcagagcgacgctccaaattaatgggatgactcctcctgcaacactatccgaaattaatgaccttacccttaggatcgttgaagatgtcctaagccttcatggtgaagaagctattaatctggaagagatccaagatattgttgaaaagcaacttatggttgccggctattatgatgtggccaagaattatattttatatagagaagctcgtgcacgagcccgtgctaataaagatcaagatggacaagaagagtttgtcccccaagaggaaacgtacgttgttcaaaaagaagacggcaccacctaccttctgagaaaaacagatttagaaaagaggttttcttgggcatgcaaacgctttcctaaaactacagattctcaactgcttgcagatatggcatttatgaatttgtattcaggaatcaaagaagacgaggtcaccacagcatgcatcatggcggcacgtgccaatatcgagagagaacctgattacgcttttatcgcagcagaactcctcacgagttccttgtatgaagagaccttaggatgcagctctcaagaccccaatttatcagaaatacataaaaaacattttaaagaatacatcctcaatggagaagagtatcgcttgaatcctcaattaaaggattatgatctcgatgctcttagtgaagtcctagacctctctagagaccaacagttttcctatatgggagtccaaaatctctacgatcgctattttaatctgcatgaaggacgacgtttagagactgcgcagatcttttggatgcgggtttctatgggcttagccttaaatgaaggagaacaaaagaatttttgggcaatcactttctataatctgttatccacattccgctataccccagcaactcctacattgtttaactccggaatgcgtcattcccaactcagttcatgctatctttccacagtaaaagatgacctaagtcacatttataaggtgatttctgataatgctttgctttctaaatgggcagggggaattggaaatgattggacagatgtccgtgctacaggagctgtaattaagggaaccaatggaaagagtcaaggcgtcattcccttcattaaggttgccaatgatactgcaattgcagtgaatcaggggggcaaacgtaaaggtgctatgtgcgtatatttagaaaactggcacttggattacgaagactttttagaattgcggaagaatacaggagatgagcgtcgtagaactcacgatatcaatacagcaagctggattcctgatctcttctttaagagactagaaaaaaaaggcatgtggacactctttagccccgatgatgtcccaggtttacacgaagcctatgggttagagtttgaaaagctttatgaagaatatgaacgtaaggttgaatctggggaaatccgtctttataaaaaagtagaagccgaagtgctgtggcgtaaaatgttaagcatgctttacgaaacagggcatccttggattacatttaaagatccttcgaatattcgctcaaaccaagatcatgttggcgtcgtacgctgttctaatctatgtacagagattttattgaactgttcggaatcagagactgcagtttgtaatttaggttccataaacttggtagaacatatccgtaatgacaagttagatgaagaaaaattaaaagaaactatctcaatagccatccgtattttggataacgttattgacctgaacttctaccctacaccagaggctaaacaagccaacctaactcacagagctgtggggttgggggttatgggattccaggatgttctttacgagttgaacattagctatgcctcacaagaagctgtcgaattttctgacgagtgctcggagatcatcgcatactacgctattctagcctcgagcttactcgcgaaagaacgaggtacatatgcttcttattcaggatctaagtgggatcgtgggtatctacccttagatactatcgagcttctcaaagaaactcgcggagagcataatgttcttgtagacacatcaagtaaaaaagattggactccagttcgtgatactatccagaaatacggaatgagaaatagccaggtcatggcaattgctcctacagcaacgatctcgaatatcataggggtcacccaatctatagagcccatgtataaacatctctttgtaaagtccaacctttccggagagtttacgatccccaacacctacctgattaaaaaacttaaggaattaggactttgggatgcagaaatgttagatgatctaaaatattttgacggatctctattggaaattgaaaggatccctaatcacttgaaaaagcttttccttacggcatttgaaatcgaacccgagtggattatagagtgtacctctagaagacagaaatggattgatatgggagtttctctaaatctgtatcttgctgagccagatggtaaaaaactctccaatatgtatctcacggcttggaaaaaaggattaaagactacctattatttaagatctcaagctgcaacatcagtagagaaatcatttatagatatcaataaacgcggcattcagcctcgttggatgaaaaataaatcagcgtccacaagtattgtggtcgaaagaaaaacaacccccgtttgttcaatggaagaaggttgcgaatcttgtcaataacggaaaaaagaggagctaaaatggaagcagatattttagatggaaagctcaaacgggttgaggtaagtaaaaaaggattggtgaattgtaatcaagtagatgtcaatcagctagtccctatcaagtataaatgggcttgggaacattacctcaatggatgtgcaaacaactggcttcctactgaagttcctatggcaagagatatcgagttgtggaaatcagatgaactgtctgaagacgaacgcagggtcattttgttaaacctaggatttttcagtaccgcggaaagcctagtcggaaataacatcgttcttgctatcttcaaacatatcacaaaccctgaagcaagacagtatttactgcgtcaagcttttgaggaagccgtacatacacatacatttctctatatttgcgaatctttaggacttgatgaaggcgaagtattcaatgcctataatgaaagagcctcaattagggctaaagatgattttcaaatgacattaacagtcgatgtccttgatcctaatttttctgtacagtcttcagaaggccttgggcagttcattaaaaacttagtaggatactatatcattatggaaggaatcttcttctatagtggttttgtaatgattctctctttccatagacaaaataaaatgacaggaattggagaacagtaccaatacatcctcagagatgaaaccatacatttaaattttggaatcgatcttatcaatggaattaaagaagaaaaccccgaagtttggactacggaactacaagaagaaatcgtcgctcttattgaaaaagctgtagagcttgaaattgagtacgctaaagattgcttacctcgaggaatcttgggattaagatcttcgatgtttatagattacgttcgtcatattgcagatcgtcgtttagagagaattgggttgaagcctatctatcactccagaaatcctttcccttggatgagcgaaaccatggatctgaataaagaaaagaatttctttgaaacccgggttaccgaataccaaaccgctggtaatttaagttggtaatttcacctctttttcaagggagttttgagagatggtcttagatcgtctctcaggatttttcagctttcccttccgaagaaagtccttagaaaaaacttcaagaagctttatactttcctaaagcaaacagtctctgatttctgctttttatgaaaccccaagatctatccccgccatttttatggaaagaacgccgtccttgtattcaagatggagttctctatgttcctagacattactttgaacaccagaatttttcaacaagctaccatcaagaattttttcaaaatcatacttctatagcttgtgaactatgctctggtaatggggattgggtagttgctcaagcgcaaaaagatcctcaagtactttggatcgctgtggaacagcgttttgatagggtaaggaaaatttggtctaaaatgatcaaccaccagatccaaaatttaaggattgtctgtggtactgccgaaacctttttccagtactatgttcctgatcagtttttgcaacgccttgttgtgaattttccagatccctggccaaagatgcggcatcgtaaacaccgtcttctccaaccctcattcgttcaagaaatctcccgctctctccaagattccgcagtttttgctttggctaccgatgataaaacatacctattggaatccatagaagcgctgcaaacacatttagctccaagaatggaaacaccatattatataaaaatgacagatacttatggaaattcttggtttgaaaacctttggcggacaaagggacaggaaattttttatacagaatttataaaaaaggctgggatatagctgacttgaacagctgaccttcacgatgtcaacgtgacgctctaaccaactgagctaataccccgagttcagctactatcctaactagaaaatggtatctttgcaataggcttcttcatgtttgcatatcgtaccctgcttacacataatgtagtccaggtatcacacgaaatttttaaaaccacagttgttcccggagatacagtcattgatgcgacctgcggaaacggtaacgacagcctttttttagcgcgcttgcttcaaggagagggaagacttgttgtctacgatatccaaaaagaagcgttgtccaatgctttactattgtttgaaacacacttgtcagagcaagaaagaagtgttatcgaaatgaaagagcagtcgcacgagcatattttagagaaagatgtgaagctcattcactacaacttgggctatcttccgaaagggaataaagaaatcaccacattggcaagaactacagaaataagcttagaatatgctttaaacatagtccgccccgatggactcattactgtcgtatgctatccagggcatccagaaggagaaaaggaaacacatagtgtcgagagcctagcacaacggttacatcctaaggaatggtgcgtgagctcattttatgtagcgaatcggtgtcgagcccctagactttttatttttcagagacaggggagtgaatcttcggttgataagggataatgcgaatctcgtgttccagatcaatgccttgcgtttttaacgttgattggatgatagctatgagttgcttgacctcatcagaagtggccttgccagtattgataatgaagtttgcatgcaacggagaaatttgtgcccctccgattgctaatcccttcaacccagctgcgtcaataagcttgccagcagaagttccttcaggattacggaaaatacagccagcagaaggctgcgtatagggctgcgtcatgagccgatgttgcagaatggatttcgagtggtcggcagaaacttgcttttttgaaagctggaaggtcgctgataaaataaactcttgttgtctatggaagcgcgaggagcgatagctcagctctaattcttctacagaataggaacaaagctctccttcagagttgattgtctcaacatttctcaccacggaagatatgtcgctttcatttgtacctgcattcataaaaatggccccgccaaccgacccagggatgcccgcagcaaactcaagtcccgaatatccattataggcagtcgctttacctaaagctgcaaaggaaagacccgaatacgctttaatacgagcatcctctaggaactgtttaccatagattgcattgtagagtacaaagccatcaaaaccacggtcatcaaataaacaattagagcctttccctatgatgaggaagggatagttgattgaatgtaggaaacggataacttcacgagcctcctcaatagtatggatggctttaaagtaatttgcaggtcctccaatgcggaaagtggaatacctattcagccacacactacgacgaacaggaaaaggaaaatgcataggcgcagcttctttcatttttagaatcccttggtctaaattaatcagattgataaagaattttcatttagagatgaatctgtgaaaatgtcattcaaaatcgcctgaatgaaaggacaggcttctgaataactaaactttttaactagacgaattgcttctgcaataagaatggccttgttaatgggtgggctgtaaaaatgctcaaagagagtcaggcgtaggacatttttttctacaagatctaaactatcaaaagacttatttttaagagcattcccaataattagatccaattcttgtgatttttctaaaatgcttttagtctggtttaaagctacgagtacgtgtttttgagacaccgcagtttgtgacataagcaaaggaactaaactgtcctctgctgaaggagccatatctagggcatacaacatctgcaagatgatttctctcatcttttgctgagggaattccttcgagatcgaaataggggaccccgagaatttttcaggactcaatgtggccatgacaagcaaccaaaaaatagttaataatacacatttaactgctaaagaggtccttagctaaggagttgtgagaaagaaacaaggttatctattagaaagttttaattgcaacaaaaacttcttagttgaaaaatgtactttgttttcggaactcacttattttctgattcagagaaagagttgctggagattttttatataaaaatttttaatttctaaagacgacaaggataattatgagaaagggatttccgttgcttttcttttcctaataccctaagatagccttcttctttctagaacggataaaagatcggattgtcttttctggaacactcagtgctttcagaccatagcaattgtcttaacaggaaattgagatagagtgtggcattaaattttaagattaacaggcaaataagagctcctaaagttcgtctcattggttcagccggagaacagttaggaatacttgctatcaaagatgctttggatttagcccgagaggcaggtcttgatttagttgaagttgcttcaaatagcgagcctcctgtatgtaagatcatggactacggtaaataccgttatggtctgacaaaaaaggaaaaagatagtaaaaaagctcaacatcaggtgcgcataaaagaagttaagcttaagcctaacatagacgaaaatgatttttcgactaagttaaagcaagcgcgtacgttcgttgaaaaaggaaataaagtcaaaattacatgcatgttccgtggtagagaattagcttatccagaacatggttttaaagttgttcaaaaaatgagtcagggtttagaggatattggtttcgttgaagctgaacccaaactagcaggtcgttccttgatttgtgttgtggctccaggaacagtaaaaacaaagaaaaaacaggaaaagtctcatgcccaagatgaaaaccaataagtctgtttcagcacgttttaaattaacagcctcaggccaattaaaaagaactcgtccagggaagagacataagttgtctaaaaagtcttcgcaagaaaaacgcaacctatctaagcagcctcttgtagataaaggtcaggtaggtatgtataagcgaatgatgcttgtttaaaggtaaggaaagttagttatggtaagagcaacaggttcggtagcttctagacgtcgtcgtaaacgtatattaaaacaagctaaaggtttctggggtgatagaaaagggcatattcgtcagagtcgctctagtgtcatgcgcgctatggcattcaattacatgcacaggaaagaccgtaaaggggatttccgtagcctttggattgctcgtcttaatgtcgcttcaagaattcatagcctctcttatagccgtttaatcaacggcttgaaatgcgcgaatatttctttaaacagaaagatgctttcagaaatagctatccacaatcctgaaggttttgcagaaattgcaaaccaggctaaaaaagctttggaagccacagtttagggattagaatttctatggaaatgaaagaagagattgaagctgtaaagcagcaatttcactctgagttagatcaggtgaactcttctcaggcacttgcagatcttaaggtccgctacttaggaaaaaaaggaatttttcggagtttctcagaaaaattaaagcaatgtacagataaggcaaaactaggttcccttatcaacgactttaaaacttatgtagaggatcttttacaagaaaaaagccttgtgcttcttgcttcagaacaagccgaagccttttctaaagaaaaaatagatagctctctccctggagattctcaaccttctgggggaagacacattttaaaaagtatcctcgatgatgttgtcgatatttttgttcacctaggattttgtgttcgagaagcccctaacatcgaaagtgaagccaataattttaccttactcaacttcactgaagatcatcctgctagacagatgcatgatactttctatctaaatgctacaacagtactgcgaacacacacatcaaacgtacaggctcgtgaactaaagaaacaacaacctccaatcaaagttgttgcccccggcctatgttttcgtaacgaagatatttctgcacgttctcatgtgctcttccatcaagtggaagctttttatgtagatcacaatgtaacgttttcggacctgactgcaatcctcagtgcattctaccattccttcttccaaaggaaaacagagttacgttttagacatagctactttccttttgttgagccaggtatagaagtagatgtctcttgtgaatgttgtggcaaaggatgtgccctttgcaaacatacaggttggctggaagttgcgggagcgggaatgattcatccccaagtactacgtaacggaaatgttgatcctgaaatctattctgggtatgctgttggcatgggaatcgaaagattggcaatgttaaaatatggcgtctccgatatccgactttttagtgaaaacgatttaaggtttttacaacaattctcttaaggaagaatggcagagcggtttaatgcacctgtcttgaaaacaggagacctgaaagggtccgggggttcgaatccctcttcttccgtttcctttttattcacgtttattccgatagaggaactttgtggctaagagccacgagtttctggtattcaacgagttctttcttttttcttttgatttcttgccttttcaggtttcatagtttttattaacttttaattttctctttattaattatttatatctaaatctattatttttatttttaaactaattgatggttaatttgtttttataataaattagaaagacgatctcataaaaaataatctaacttttttggttccatcgaggaggtagaatgaaaaggtctcgacgtaacttcgaacaggctttagaaaatttagaaaagctcaaagagatttctttagctacctcgaatgattcctacctaaataatccagcacgcttcaaccagagaaaacaaacaggctcttctgtcatggaaatgaaagaggctctgaaaaatgttgaaaattatctactcgaaatcagctgtgtttcgaaaagtcatgcagataaagctcttaaagaatcagattttttaattgcaggtgtgcaaaacgtcttttcctttttagagaaccaagaagacctctataagtctttactagacgaatattctgaagttactaaggcttatgatgaggtaaaaaagaatcttaaagaagtcccaacttatgacctctcgacagatgaagaaaccgaggaacacaaagaacccgagtgctttttaaataaccttgttgaagttaagcgggaccgttcctatgagcttttctacatgctagatgagcaagacaaacgcttttataacgatgctcttgtccagatcatctataagcaaaataaactacacgaaactgtaaatgaaggtgaccccctaactaaaacactcctctggaatagtgaagaagttaaaaacattgcctcttcgctggttatcgtaaatgatatgcccttgcgattgttttatcagcgtgctttaagccatttagacatcgaagctgtggtcaaagttcataacgcagtcatggcgttgttcttctcaagatacgaagctacaatggtcttcaaaagccctaagaagcataatatatggtactttaatgactttttgctctttttgagagaagcatggaaagacttaaataataacgtgattgattctcaagagagaaaacagacgaaacttcttgcttccgctttaagtctcgggatctttgaaagcaaactagtatttgaagaggcatctcgttatctctacttcaatattcaaacgaaattagaaaacgccaacgggaagaagcctctttcaccaggacaatatcttacagacgcttatgaagaacttcatcgtcttatctctaaatatcctaacgggcctctttttaaagctatggatagagttttagaacatgaatcccgtccctatgatcctatgattttaggaatcctccctagccttgaaggaacgttaaagctccacgggaaatctatagatatcatacgatctcccagtcctgtgacccaaagctcgattttgtatgctaattgtaatgaggaattcttagggtttcttaatgctaaagcacatcgcagtgaggtgactttagttctaaatattcagaatcgtatatcaagaaaagaacgtgcgcgaagccgtgttatcgaagaagctttagaacaagaagaacacgccccctatgtccacgccttctctttccctgaacccgaagaactcctccagaatttggaaagtattcatggagatattgaaacttttgctgatttcttttctattctgcaagaagagtttcataaaccccttcttgcttcatcattttttctaacgaaagaattaaaagagttcgtaggtagcttcttaaaagaaaaactcacggcgttgaaagacattttctttgctaagaaaaaaattctattcagaaatgataagcttttgcttctacacctcctctcgtacctaattgtctttaagttaatagaacgtaccaatcccaactctattgtcgtcgtatctaaagatgggctggattatgtttctgtctttattgcgggatttgcgttcttttctagggaagcgttttgggatgaacatagcttgaaactattacttacgaatgttttatctcctacactcgtagctagagatcgtctggtcttcgtatcccatattgaactcttaagtaaatttgtaaactgtctaaagaaaaatcgtcagggattttctagtctgaagtctttcttcaaagatgacattgaaggttgggagttcaccgggtacttgcatgaactcactgaagtttcgcataagcataatttgtaagtagaaagagtactataagaggaaaagccatcacaggaagtgtgggaagaacgctgctactggctaagacgattcccgcctttaggaagacaaagaaaatatttaccgtccctaaagggatcaaataggctagagtgaccgttggtgttctactaaatctcaaacagagataggcagataaaatgatagccgccatacaggcaagtggtgaaattaagacgtaatagaattgagccagaagagaaagaatcctttgtggcacttgtgtcgagagtcctaaacctgtagcgttccaagggatggccttgaaaaattctgaaagacggtttttattccctgcagaaaatagcttggaaaaaggattttcatagaaattaaactcgatctcaggaaactccttcatatcgaaaaactccttaagctcaagattttctgaatcattagcgaaaaattgtgtgacatttaaaccaatcggaagagagagggtggtgaacgctaacttttccatggtgtaaatggttttaggatctttgatccagaagacattatttaaagtaagcgtcttaggctcaatagaagaatataagagtactgtttgatctttgaggtaaagagcaggaatttttccctgctctttatctgtcgtgcctctatccatattttctttagtaatagagattttctcgcaaataggatgcaaccactggaaattcgcatagagcaccatcatgatcacagctcccgaaaggagaagaggatgcattagagattttaaggagagaccagaagcttgtagaagaataatttctcgcttattttgcatagcaaaaagcgtgcttgttgttgctactgcaacaagctgaggcatgaggaactctgcttttaacgaaatctgtgctaggtagtacaatatagagagcttgacagaagctccagaagcagctgtagaggcccctttaagggtatgcaaagagtgatgaatggaagcatagaatataagagcaagtaccaaaagagaggtaagtgcaaaccaaaatctagtgagtaagtggcgtttccaaatcaacatacgttaagcataccctcgactttccctatacgcgcgagcagcaaagacaacccaagagaccaattgggggaagacaaatagcatgaaggctaggggtagattttttgtatttttcccaacgataagcagaataaggtccaaaatagggaaaatgaaatataaagctatagattttcgaaatctaggtttatgaattccaaggatcatgccagcatacgtcagcgtgatacagagaaaaccaatagcaactcttcggagcgtttcaggaagatgcgagtgctttagggactgtttaacaagctgcttccaaggcagatagtctgtccgtgtctttaaataagattttcctgcaaacaatgttgaagtaatcttgggaattagcaattcatctaaggtttcaatatagaatctttgagaagatggtgaggaagattctgttaacgagtctggaagctttgagataaagaccacatccttagcttttacagtatctttagtagtgtcagggatgatactttttataattcccacatgggagatctcattatttccttttagagctacaatgacattgtcaaacttgcttttagcacaatgatctacagcgatgaaaatacgattgttttcttttttctgtagagtctgtaagagcagggctggtgatgtcattgccatgtttgcaatttccttgcatgtttgatagcgacaaattgaagcaagctctgagcatgtgtaaaagtttaaacagcaaatggctccagaaaccatcaaaacaggaaacatgatgatgctttgagaagctccagacgctcttagaaacgtcatgtggttgttatctgataatttacggaaaagagagaatgctgagacaaaacaagagccagggagaataaagggaagaaggtaggggatttggtaagccattaaacgtaagactgtatcgtaaggaacgtctttagcaatgtaggcaacaatttcctgtagagagctaattatagaaatacaaattaagcttaaggtacagaaagctgctgtttttaagtaacggaaaatgagaactttccataaaataggcatggcttacctggtaattacaatttcttagatgccttgatagagtgaaagagtcacgatctgttttgaaaaatccctagcaacactattcttttcaatgatttttatataggcgtataaaatggtactaagctcagatttactccgtgatgataagcaattagatcttttttttgcttctttagatgtaaaaaaaagatatttgcttgctctttctggaggaagcgactctctttttcttttttatctacttaaagagcgaggggtttcctttactgcggtacatatagatcatggttggaggtctacctctgctcaagaagctaaagagttagaggaactttgcgctcgtgaaggtgttcccttcgttctatatactttgactgctgaagagcaaggagataaagatttagagaatcaggcaagaaagaaacggtatgcttttctttatgaatcctatcgacaattagatgcgggaggaattttcctcgctcatcatgccaatgatcaagcagaaacggtcttaaaacgtttgttagaaagcgcccatttgactaatctcaaagctatggcggaaagatcatacgttgaagatgtgttacttttacgacctttgttacatattcctaaaagctcgttgaaagaagctctagacgctcgcggtatttcttatttgcaagatccttcaaatgaagatgaaaggtatttaagagcgaggatgcggaaaaaacttttcccttggcttgaagaggtctttggaaaaaatattacctttcctttactaactttaggtgaagaatcagcagaactatccgagtatcttgagaagcaggcacaaccatttttttctgccgctacccatcaagattctcaaggagagcttccctgtccagactgcctcattcaacaagcgtttttatgcaaatgggttatgaagaaattttttaataatgctggaattgctgtttcaaggcattttttgcaaatggtttatgatcatttatctcggagttcttgcgcaactttgcgcatgaggaataagatagtaatcataaaacctggagtagtagtgatagattagaaagtatatactcattatcttctctatatgtgaaaaaaagagagaacactaggtcattgtattagtgcctgttcatattttttatttggctgttatagtttaaaatattttttctaaaacaaaataataaaaaatatgttatattgaataattatccgtctgattgattagcttagttgtgaagtttatgtcgaaagataagaaaatgaaacctgaaccgaaaaaaaatttccctacagtctttttttttcttttgtttggcgtggtttttggtgtagtcgcatttcaaaattttctagctggaaagaaggctagagtcggtttcagtcatcaaatcgagcaccttgttaacttacgtctgattgttccagaagatagccataagatagctcttaatgacaacttagtttcttttggcggacgttttcgtgatgtccaaactcaagaaggacaactacgttatcattatctagagcttattgatcagggccatcggttagaccttgatcttcaagagacgagcaagagtcttacgaccttagggaaggaggtcacgaattccatactttggttttctgcaatttctggatccccgattcctgaacaagggtatgccatttcttatccgagtgaagtcagcggctctgtattgacagaacctctcgttgttacaggacctgcaactccacagctaatcaatctccactctctgcaggagcgttatcctacactatcacgatctccagaagctttacgcacctatggatccgatctttatgagttaataggaaaatatctatctcctgttttaggaataggatctgagacgctaaaaagagaacttaaagatctctaccagcaagtggaagtctccttaactcaggagacggatacggaagcagcctacaccctttatgggcaggttcttagtactttgaacaggatctcttcttctttagtcgtgtctgagggaggagaacgtttttctcaactccgttctgtacgtctctatcgggaggagtggaataagtatcataaattggtggaagcgcgcgatctgaatcaagcgcaactagagaagctccgtggtgaattaagccagacagtttggtattttaataaccaagagctctcctcccgtagtttagagaaacaagatcctgaagtttttggccattggtttgccggggctaaggaagagtggactgcctttaaatttaaccactccctatcatttaaagctccagaccaaccaagaaatctcgttttagagaaaacatttaagagccaagagccttcgccacattatttaggatatcttttcacattcttacctatcatcttagttctactctttgtctacttggtgttctctcgtcagatgagaggcatgagtggttctgcaatgtctttcgggaaatccccagcgcggatgctccttaagggacagaataaggttacctttgctgatgttgctggtatcgaggaagctaaagaagagctcatcgagattgttgacttcttgaaaaatcctaataagtttaccagtttaggggggcgtattcctaaaggagtcctcttgataggacctccaggaacaggaaagactttgatagctaaggctgtatctggagaggcggaccgtccctttttctccattgctggttctgattttgttgagatgttcgttggagtcggtgctagccgtatccgtgatatgtttgagcaagcaaaacgtaatgctccctgcattatctttattgatgaaattgatgctgtaggacgtcatcgtggtgccggtattggtggtggtcatgatgaaagagaacagacattaaaccagcttcttgtagaaatggatgggtttggcaccaatgaaggtgtcattcttatggctgcaacaaaccgtcctgatgtcctagataaggctctattgcgcccaggacgtttcgatcgacgtgttgtaatgaaccttcctgatattaagggacgttttgagattcttatggtacatgccaagagaatcaagttagatcctactgtagatcttatggccgtggctagaagtaccccaggagcttctggagcagatttagagaatttattaaatgaggctgccttattagcagcacgtaaggatcgaactgcagtgactgctgttgatgtcgctgaagctcgtgataaagttctctatggtaaagagcgtagaagcttagagatggatgccgaagagagaaaaactacagcgtatcatgagtctggtcatgccgttgtagggctttgtgtacagcatggagatcctgtagataaagttacaatcattccaagagggctctctttaggagctactcatttcctaccagagaaaaacaagctcagctattggaaaaaagaactttacgaccagctcgcagtgttgatgggaggtcgtgctgctgaggagattttcctcggagacatttctagcggtgctcagcaagatatatctcaggctacaaagttagtgcgtagtatggtttgtgaatggggaatgagtcctcagctaggaaatgtgacttatgatgagcgttccgatggcttgacaggctacggtggttatcatgaaaagagctattcagaagaaacagcaaaaactatcgatacagaattgagaatgcttctagatgcggcataccaacgtgcgttagatattattaatgagcataaggcagaaatagagcttatgactcagatgctcattgaattcgaaactcttgattctaaagatgtgaaagaaattatggaccatacttgggatcctgagaagaagagagcacgtctaaaagaagaagggatgctatttaaaaagtcttccgacgatcttcctcctcctcctcccaaggaagacactctacctggtttggggtttaatgctacgtaggtaggaatacctcaagatgcattctgatccgaaaagaacctaggaaatcctcctaggttctttttttgtctcaattgaatcagattagagttagatgtaatcataaaaaaagctagtctttctaagaagactagcttttcatgttaagcgtatagaatagaatgtatgtgaaagattattctagagttgctttatggctcaacttaagttgacctttttcattgatgcttaagagttttacatcaatgatatcgccttccttaacaacatcacttatattttctattcgctgtctagaacactcagagatgtggcagagtccttcttttccggggagaacttcaacaaaggctccaaacgcaactacggaagttacgcgacctctgtaggtttttccaacttcaacttctccaactaaaccttcaatgatttctttagctttattgatagctgatgctgaggacgcagagatgctaacaactcctaagtcgttaacatcaatttggacgccagtctcttcaatgatctgacggatttgcttgcctcccggcccaattactgaagcaatttttgttggtttaatttgcattgtttcaatacgaggcgcgtattgagataggtctgctttgggagctgaaagggcttcgttcataatatttaaaatatcattacacccttgcttcgcttgggaaagagctttcttcatgatagctggagtgattccttcaactttgatatccatttggaaggctgtaattcctttaccactccctgctattttaaagtccatgtctccaaggtgatcttcaagaccggaaatatcagaaaggataatcgctccttgatcatcaaggatcaatcccatagcaattcctgcaataggagaagaaatagggacgccagcgtccataagagcgaggcaaccgccacatacagaagccatggatgaagaaccattagattctgtaatattagattctatacggatggtatagggaaatgtagcgctatcaggaagagcatgacttaaagccttctctgccaatttgccatggccaatttctctccttcctggagagccgattcttcctacctctccaacagagaagggagggaagaagtattgtaagtaaaattttgaaagtccttcaccattcaaatcctcatagcgttgagccattgcctcactgcctaaagtacataccgcaagtgtctgagtctctccacgagtgaagaggcagcttccgtgagtacgaggaaggtaagaagtttcaatagtaataggacggactgtagttaaagaacgtccatctgcacggatctctctatctcttatgagagcacgcatcgtgtcagattttaaagttttacatgccgctttgatgttaaaagaagagaaaagatcatcatcttcgcgctgtaatttttctaaaatattttcttcaatctcatgcgcagtagctgcatgtacttttttatctttaatattaaagagttcagtaaacttgtcttgcgcacactctttcacagctgttaaaacttctgcaggaagaggatatacagcacttagatttttagattttccaacttcttcttgccacaactgtaatcttttacagatggtaacaatatgcttgtgaccaaattctatggcatcaagtacttgctcttcggtaaagaaatcgcaatgaccttctatcattagaatagcgttttctgttccagctaatacaagatctaaagtagaggatgctaactcagtttttgtaggattgatgacccattggttatcaatacatccaatccgtactccagcaacaatgttgctctgtggaatatctgaaattgctaaagcagcagatgctgcgcagatagcaagaggatcaggtaaaacttgaccgtcatacgaccatacataagataaaacttgcacatcttgcatgagtcggtaggggaaggaaggacgtagagaccgatcaatcaatcgagaaactaaaatttctttttcagaggggcgtccttctctttttataaatccaccaagagttttccctgtggaagagaatttttcttggtagtccactcgtaaaggaagaaagtctactttgtcatcaagatctacagcgcatgcacttgcaaaaacacaggtttcccctgaacggacaagaacagctccgttagcttgacgagcaattttccctgtttcaaacaccaatattttaccttcggtcagattaatagaaatagtttgaaaattcatgaaggtctcctgttagatatttgtaaagggaacgaaaaaactacttacgtagattcaatcttgtaattaaatttttgtacctttcggtatctgtagaattaagatactccaagagctttctcctttgaccaacaagcttaagcaatgctaagcgggagttttggtctttaggggatcttttaagatgttctttcaattctgcgatatgttccgtgagaatagcaatttgtacatctgccgatcctgtatccttttcatgaagttgaaacttctttgtgatttcttccttagttcctttatccaaagacatcggatgtctccttaaaataattgccgcaaaagctgattatacttgagaacatggttaatgtacaccttttggtagggtaagacttttttttctataaacaaagaaaaaattaggggctgtggaaaggtctgagattgcttcataaaagcgttttattgatattgtatattgttattttttttgtttttagaactcataatggaataaataatattatttagaattgggtggagagaagcttatcaatatggaaaaagatattttttttatgcaacaagccttcaaagaagcgcgtaaggcatatgatcaggatgaagttcctgtgggctgtgtgattgtcaaagacgataagatcattgctcgtgcgcataattcagtggagaagcttaaggatgctacagcccatgctgaaattttatgtatagggtctgcggcccaagatttagataattggcgtttgttggataccgtcctttactgtacgttagagccgtgtttgatgtgtgcgggtgcgattcaattggctagaattcctagaattgtctgggcagctccagacgtgcgtttaggagcaggaggaagttgggtcaatatctttactgaagagcatcctttccatacggtttcttgtactgggggcgtgtgtagcgaggaggcagagcatctaatgaaaaaattttttgtagaaaagcgcagagagaaaagtgaaaaataaaattgttacattattagatcagctctacgaggatcaggagtcacgacttcagaagttaggagaggaaattgttcctaacctcactcctgaagatttattgcaacctatggattttcctcaattggaagggaatccggcatttcgttttgaagagggtgtcttatcaggaattggtgaggtgcgagctgcgattttagcggcgctctctcaagagaactagaatctcaaagaagtagtataggggttggggatcttttcttttttacaaaataggatagccagaacgatcgcaagcatcgatgcgaggagtagaaggaaggcccctgagaaaataagaatgcaacagtagaaccctaagacgaacaagaatccccactttattgagacggataggggagtgggtcctatggtaaagcgcttttctggatctaagaagatctgtactgtcaaaacaccacagataatactttccggaccgaagaaagattgggagctgtggatgagagccatgaatccccagagaacagctcctataatgagtgcctggcctgagattacaacgagaacactgaaggctcccaatttgcggatgaggtgttggatagctttatagaaaagaaaaaaatccaagacattgcgcaaaagaagtctttgggtgatttcgaagctttgatctttatttagggatagggaatctgctgtgattagggggtaggtgagaaactgccaaaaatggtgtttctgtatccctttaacagagagggctagaatttcgaggagcccaggaattccaaaaaatttatttatgatataagagaaaaacggggcgatacacgaagtaactaatataactgaaggaagtttttttaaaagcttggataggttggggaagttattatgtttatcggggaaaatcaccctcatggaggctttacctgcaatctgacggtcaggcccccatagtagaggatgaattgttttattagaagtctattgtcatagtttagtcagagggtgagttcgttagatttgccttgattgttagttcctttagggtagagagcatggagctggtggcttgtagaatttgcatggattctatggttgttgagtttacagacttttggtttgcctgtgctctttgttgtgccgaggagagctcctgttgtatcatttgacgatttgctgagatctgttggtttgagctttggtaggcttggatttcattttggttcttatattcgtcatcgcttccatcttttttctgtagatcgggtactttaagtaaggggaggttaatgagctctttcactctttgctgttggactattgtattatcttctagtacggctaagattgatttgccgtactctgttgtggattcagagagccgaagcatgacggagatgcaaaagtagaatgcagactgtttgttaattgtgatggagtcagaaattacttttgtagaatcaggaatcactttatcggctttagttgttgtattagagacgggttgtatcgacatgagttcctctatacttagatgttagcaattaggcttacaatttgagagaaggtctggataagagcctgtcctacctgtaaggattgttggatgatgttattatttgtgttcaagttactggagattacctgagccgcgtttcctaaactggaaatttggttttggatagcttgccgagaagctcctatcgcttggttatcggattggatgttttgtagatagctagaggagttatcgttcagtttatttttaggaatactgacgtattggtataaggcttcttggttatttaggtaggtttgagctgaagagtttgcttggagttcttgggcaatgatggagaggttatcttgagcaactaatacggattgatagacgtagtaaacagtaacaatcagagggtttgagtctttggagaattttgcaatgatatcgtcagcagttgctgtattaggtcctcctgtaattggagtgccaggaacatttatggctgcttgtagaggtttttttgctgatagagggtctatgatccacatattcaacctaactggttttcgattttaaaatgtttacggatggttttaattccttatcctaggggtttattcagttggtttacggtgcttcctatggagtttgttgttttgataaatgaggagtcttgtgaggattgctgttggatgatgttaatgtttgtagaggcgtgtgagaggataatttgaccgttttgtcttgttgttacgagttcgtcttggatattagatctttgtgctgagtagttttggttctgattttgtactctagtgatctcgtcttcttttgctccagcacttactattgcatacttgatttgattagtttcttggtttaattgttgttgaatattagtattgtcgtttaattgttgtgattgagtcagaactgtttgttgtcgaatttcaattgcttgtaaaagaagctcgtaaatgctaaaaagcacagcacctattttaggtgtatttagaggctcaaggggaggacgagaactgtttatagtattaactgtgggaagagtccctaaggtggttatagacataataaaaaaattcacttttgtttagttttattctaacaagaagaaaaacgtttattaaaataaaatttttatgatttttctttattagttgttattaagtgttttgtttttttataattaataagaaattttggcggcccagagaatattgggtactagattggagtaagaagagcttaatatgggtcctaatggaggcttttgtagactccctagttgtggtataaatctttagctggagaggagaaggacgtgtctgggaatgagtgcaatgactatccagaagtttttaaagatgacgtaagtgcttacgtattggtaacttgtggtcagatgtcttctgaaggcaaaatccaggtggagatgacttatgaaggagatccagctgtgatcagctatttattaacaaaagcacgagactctttagatgagtcttaaactattcatttattgggatgttgaaaccgatgtacgtgcttagcaaacgtctttatcgatgggtaaatcaactaattaaattaggggatttggtaaagaactcacgatcattttctgtggaatgggtttttatcagcgctctgttgttgatttttggatgtttaggctgcgcatctgttgttaaagtttctttagttccctttctattactattttcgtttttagcgtttcctctgattttatgttttcgtgggaagggctatgctttgcttctgggggtttttgtaactctttatgtcgctaagtatgttgttggagagaccttatatgtctctttttggttatctggcttaggagtctcctttttgcttgcttttgggcttttcctccaaggagtgtggcttgctcaagaagaagagatggtaaaggggaaggagcaactcaggctttctgaggatttggatgcacaacgtagtgcttatgaagatttgctgctgacaaagagtcaggagaaggagtttttagatgctcgtgctcagggtttagatcgggaacttactgagtgtcaggagcttttgaaagcggcttatcagaaacaagagtatttaactatagatttgaaaattctagcggaccaaaagaacagttggttagaggattacgcggaactccataataagtatatcgagttggtttccaagaatggggatgttgtatttccttgggtagcagagccttcagtaggtgaaagtcagggctcagagagggtggatgtttctagatgggtatcggctttacaggagaaggaagagagtttagagcgtctacgaaatgagattttagtagagaagcagcgttgttctgattatgaacaccgttgtcaagagttgggccttttgttgcaaaatttcactgctcttgaaaggagatgtgaggagcttcaaaaccttttaaatcagaaagaaacgcagataaatgagctccaccaattggtctgtaaatctgaagagaaggtctctgtggaaccttctgcacatgctgaaacgagttgtgtggaagaaaaacagtataaagggttgtattctcagcttcaggagcagtttctagaaaagagtgagactctttctttagtaagaaagaagctttttgcggttcaggagaagtatttgactttgaagaagaaggaagaactcacaaagcaagacatatcttttgatgatatctctatgattcaagggctcttagagcgcatagagattttggaagaagaagtcagtcatttagaagagttagtatctcgtagcctgtctctgtaattgctatagtgtgttcccattgtgcgctgggttgattatcgcatgtgcgtgcttcccattgatttttggggtctacaacgccttctttttttcctacattaatcataggctctatagtgaagatcatccctggtgctagaggaatcatggagcggtttctataatgtggcacgtaggggttttcgtgaaactcaattccaacgccatgtcctacaaattggtctactacagaaaatccataggtgtctgcacgtgcttctatagcttctccaatttcacagaggggaataccaggttttaaaatggctatagaatcgttaagacattccaaagctgcttggcatatcttctttttaatttctggcacctctccgatcatgaccatgcggctacagtctccatagtagccatccacaatgcaggacacatctatattcatgatatcaccgtcttttagtgggatatcgttaggaatcccgtgacagatcacttcgtttaatgatgtgcagattgtttttggaaatggtggtgagccgtaatggaatggagcggcaatcgcgtcatatttcttatggagctcttgggagagctcatccaactcatttgtagtgacgcccttttgagatgctttgcatagctcatctagaattcttgctgtaatttggcaggcgttatagatttttgctttctgttctggggttttgagtaggatattatattgcgaggcgtagtgttgttttaaggcttctggagacatttttgggggttgagggtagtggcactgtttccatttacgtccactgccgcaccagcaagggtcgtttcttttcataaggatcacccgatgtaaaagcctatattaaacgctattgagatccctttcaacataaggtttaccgacataagtagtaaagcaataccgaagagtctctcgagtgcgaggagtccgaaatttccaaaaaggcggtcaaagaagctagagcatagcagagtaaataaagaaaatgcccaggcgataatcatagcagtaaaaataatttccctagagtagattccctcttccatgtagctaaggagtgctgtaatcacagcagggcctgtgattactgggaaagctaaggggaaaaatataggttctgttttggaagtatcatctttagctttttctggcatgggtgccagcatcatttttatagagactgtaaagaggagaaagccgcctatgatctgaaaagcgtagagagaaatatccaagaattggaagaagcttcttccaaaagtaacgaagaggatgagggctccgagagcaaaaaggcattctcttaggatcacccgttgttgtttctttctagaaaagtttttgagcaaagcaacaaagacaggaatggagcctggagaatcgaacaggacataaaatagtaggctaagattgagtaagatgagcataacttattctataaaaatgcttgttgtaatcctgagactaggagttgggtacccacaattgttacaaaaagtcctaaaacggtttgtgtagctaggagtactttgttccctttgcagaagatctgaagagaaaaggtggctagggtaatgagtagccagctgagaattaggatttggaaattgatcagagtattgtgatttctcgctatgagtgtacagcaagctgctaaccagagggtccaaacattaaagggagagctattggagaaatgcacggagaatatgagggggacatattgaatttataagggatccaggattcttcttttcccaatcgcaaaacagctcggactcctgctagtgttaccgcaattcctccgacaacttctatagcgcatacgggggtattcaatactttcaggcctccgagagcgagtccgtaaagagcaaacatagcgatgaatgcgaagaagctttctctcagtagaacaagcattcgctgttttactgaataattcgcgaggagatggtgtagcgctaggatattagttaaagagtctgaggctagcagcagaatgcatgtttggggcaagaaaaaagaaaactgtatcatggggtaattttttaacctcatttcctattattttcaagggaatcctctagaggatacttcggaattgggagagtttatcgaggtttgtataaattttatttataggtaatattttttagaacagggtgtgagttacacactctgttcttctggtagtgacggattgtagaggtcgtttagagaaaacttcgcgacttctgaagcaagttcgggataccgtttaatgattgtttcgaggagtttgtctacaaggtctttgcttaagggatcttgggactgagctaggagggggaaagtttcctcccattggagatactcctgatagagatttttaggtatgcttttagtttctttagcgtagagtttaaaagcatcttcggggtggtcttttgagaatatgatgctttcttgaagagctttttggaaagcttcaacaatttcgggttcgctagctttcgttccctttttagtaaagacaatcaactgggggcctgtgggaagatcacaggtatcggagagaaagcatttcacgggcatgcctaaagtttgtaattttactccttcaatattgtagaaagcgccgtagaggaaatcaattttgtttaataacatcggagagatgagatcagaacttacatttttgacttcagagggaaccacaccgttacgatttaaggtttcaagtagacgatttagatctctggagttgtttaagcagaaacctaagactttgccatttaggtcttcaaatttgtagatggggtcctgacttctgtagagaaatccttgcagggaactgtctatcaatctccctacgatttgtattggcatgccttttatggaggtcttcatgatgccgagagcatggtaaagggccatatctacttgttcaaatagaacgtggggaacagcagaacttgagtctgtatttttttgaagttgtagatccaaaccgtgttgtttgaagtatcctttggctactcctgcatagaggggaatatggttaggattgggggtccaatcgagtaaaagtgttagtgaagtaagattttttttgtcaggaggagatttagagtttcctttccagggaataagcattataggaattaaggcgagtacggataaagcttttttagctacggatttgtgcttaaggctcatccgttttactcggaatagtgaaaaaatcaatttttcaattaacaaggtgatttggaagaggctgagggtgagaattgagagagtcgcgagtcctgcgaatgctaattccatttcataatttctgcggctttcgagcataaggatgccgagacccgattgggaggctacccattctcctgcaatggcagcaaatcctgcagatcctatagcaatttttaatcccgagaatatgtgggggagagcgtggggaatccggagtttgatcaggagttggaattttgtagctccgcaaaggacgaattgctctataagttcttctggtgttgataagatgccctgatagatagtcagggtgagcggaaagaatatggtgagtgctgtagggacgattacagcaccgattccccagccaaaccaaagtacaatcagtggagccagagcaaacataggagtgcactgtagcaggatgaaaagaggttgtaggagatctttagctgatttataagacaacataattgttgctagaacaatggagagagtaatcgcaaggaagaaccctcctagaatcgcttttaaggtgtgccaagcagatgttaacaagagtggaagggattggagagtactagaggcaatgctcgaggggggagggcagaaaaaggaaaacgtgggtcggtggcgtgacgtcatctcccaaagaaatagcagggaaaaaacgataacaaagtagaaaataaatttttttttcatttttgaagtaattaacgagaaaatagcctaaatcataggggaaatatagatatgcgacaagaaaaggatagtttaggaatcgtagaagttcctgaggataagttatatggagctcaaactatgcgttctaggaattttttttcttggggacctgagttgatgccttatgaggtaatacgagctctcgtatggattaaaaaatgtgctgctcaggcgaatcaagatttaggatttttggattccaagcattgcgatatgattgttgctgctgccgatgagattttagagggaggttttgaagagcatttccctttaaaagtttggcagacagggagcggcacacaatctaatatgaatgtgaatgaggtgattgcgaatcttgccattcgtcatcacggaggggtgttaggcagtaaggatcctatccatcctaatgatcatgtgaataagtcccaatcgtccaatgatgttttccctacagcaatgcatatcgctgctgtgattagtttaaaaaataagttaattccagctttagatcatatgattcgggtgttagatgctaaagtggaagaatttcgtcatgatgtaaagataggacggacccatcttatggatgcggtgcctatgacgttgggtcaggaattttctggttatagcagtcaattgcgtcactgcttagagagtatagcattttctttagctcatttatatgaacttgcgattggagctactgctgtagggactgggttgaatgttcctgaagggttcgtggaaaagatcatccattatttaaggaaggaaacagatgaaccgtttattccagcttccaattatttttcagcactgtcttgtcacgatgctttagtagatgcccatgggtctttagcaactttagcatgtgctttaactaagatagctacggatttgagctttttaggttcaggacccaggtgtgggttgggtgagttatttttccctgaaaatgaaccaggatcttctatcatgcctggtaaagtcaatcctacgcagtgtgaagctctccaaatggtttgtgctcaagttcttgggaataatcaaacagtgattattggaggaagtcgaggaaattttgagcttaatgtgatgaagcctgtgatcatctataatttcctgcagtctgtggatctcctttctgaggggatgagggctttctctgaattctttgtgaaaggattaaaagtaaataaagctcgtttacaagataatatcaataattctttgatgttggttacagctttagctcctgtattaggttacgacaagtgttcgaaagcagcactgaaagcatttcatgaatctatatctttgaaggaggcgtgtctagctttgggatatctttctgagaaggaatttgatcgtttagtggttcctgagaatatggtgggaaaccattagaattttttaaagagagcgaacgctgagtgtattgtaaagtaccgtagcgtacgttttctcttcccttgttatgaaaatctttaaggttgcttttctaggatttagactaaatgacgagttgaagttttgctctctagatttgttagagcttgggcaaataggagagcacttttaatatttgagaagatatggtccaccccaatcagttcatctagatgataacgtttcaggtcagcaaggggagttttcttaactccagcgaggagaagtagggtcccttgacgatcacattccaagaaaaattcttcgagagcatgcatagctgaggcatctattgtggggactcgcgtcatgcatagaataaagattttagggggtttttctatatcattaagaagattctttaatctatctgcaattccgaagaagaaaggaccattaatttcgtagatctctgtgttttgaggaacttcagctttgcttaaaaagtctgaatccttatcgaagtatttggctgtggagatcacatcggaaagatcactcatttgtttcataaataagaatgccgctagcatcattcctacttgtacagctgctgtaatcgttgtcattaccgtgaggatgaagacagtgaggagaaccacaatatcttttttaggagcggtaaagagatggataaagtggtggatttcgctcatattccatgcaatcaaaatcaaaacggcagcgaggcaggtgagaggaattttgacagtgagtggggccagaagaagtaaaataaagcaaataaagatggagtgaacgattcctgctatgggagttgttgcttcagacttgatgctggctgctgtgcgagatagcgaccctgtgacggggattcctgaaaataatgaggttccgatgtttgctaccccttgggcgacaagctgacagttggattggtgacgccatcctgtcattccgtccgcgaccacggcagatagtaaagtctccaatcccgataagactgcaatggtcagagcgtctggcatcagttgaagaattttggtgatgctcagttgtgggattttaggtaaaggaatcgcggtaggtagagttccgtaacgactgccgatggtaggaatatcgattttaagtaaccaaacgagggtggtcgccgttacaattgcaatcatgactccaggatagcgaggcttgtagtttcggaagtagatcatgatcaatagggtaaagagacccaccgcgaaggacttactgtcccaagtccataaatgatcccagtaagctatccatttagggaggaaatctgcaggaatattagctcccatttgcagacccaggaaatctttaatttgcgaggagaatataatgatcgcaagtcctgtggtgagtcctgtgacaacgggatagggcatgtatttaatgaacgtgcctaagccagtgagtccgaaggcgataagaaagacgccggccagcaatgtgacggtaaaaagcgcctcagccccgtattttgcagataagcagtataaaatagaaataaaggcactggatggccctgaaatcagaacgttacttcctcccatagccgaagcgagaaggcctccgataatagaagctaacagtccctgaattggggagactccgacaccaatggctatggcaatagcaaaaggaaaggctaggattcctacagtaattcctgcttggaaatcctttttaaaagtattaaacgaatagccttctttgatacttgtgtagagtttagggatgaagtttttaaatgcccaagggactttcacgatgcaataacctaaagtagaagccagtgcttaccattttttcgattcctttgaatctttgtcaaatggttcgtgcaattttttaatcttttttcttcatattctctgtctagggatccgtaaaagaataattacaaaaatttttccttctttacctctgtaagagttaggagtaaagtagatcacgaaatcattttagaggtgaccatgctgaaactacaattgtgtgcgctatttttattcggatatctcgcaattgtctttgaacatattgttagagtgaataaatctgcaattgccttagctatgggaggactgatgtggttagtatgcttctcccacattcccatggcggatcatatgattttagtcgaagaaattgcggacatgtcccaagtcatcttcttcttgttctcagcaatggctattgtcgagcttattgatgcgcataaaggattttctgtgatcgttaagttctgtcgtattcagtcgcgaaccctgcttctctgggctcttatcgggctttctttcttcttatccgcggccttagacaatcttacatctatcattatcattatctcgattttgaagcgtttagtgaaggctagggaagatcgcttgttattaggagctatttgtgtcattgcagtaaatgcaggtggtgcatggactcctctaggtgatgtaactacaacaatgttatggattaacaacaagattacttcttggggcattatacgtgctttatttgtgccgagtttggtctgtgtgttggtcgctggtttttgtggtcaatttttccttcgtaaacgagggagtactctcattgccaaggatgtagagttacaatctgcgcctcctaagagtctttggattatttttataggtttaggttccttactcatggttcctgtgtggaaggcatgtttaggattgcctccttttatgggagcgttgttaggtttaggtcttgtctggttaaccagtgactggattcactctcctcatggtgaggatcgttaccatttgcgagttcctcatattttgactaaaatcgatatctcttcgattacgttctttattggaattttgcttgctgttaacgcgctatcttttgccaatttgcttacagatttttctctatggatggataagatcttttctaggaacgtggttgcaatcgttatcggattgctctctagcgtattagataacgtacctttagtagctgctaccatggggatgtacactcttcctcttgatgatactttgtggaaattgattgcttatgctgcaggaacgggaggaagcattctgatcattggttctgcagctggtgttgcctttatggggctcgagaaagtagactttttatggtacttcaaaaggatttcttggattgctttagccagttatttcggcggattgttttcttattttgttttagagagcctcaattttttcatttaattttttatagggaaacaacagagactgtgcgttcggtttttctatgattttgtgtattttttcagataatgtttttaaaaaaatgttttaaaaccctaaaatcctacctccttgtaaccattctcggtagaaaagagaggtatttatgaaaaaagggaaattaggagccatagtttttggccttctatttacaagtagtgttgctggtttttctaaggatttgactaaagacaacgcttatcaagatttaaatgtcatagagcatttaatatcgttaaaatatgctcctttaccatggaaggaactattatttggttgggatttatctcagcaaacacagcaagctcgcttgcaactggtcttagaagaaaaaccaacaaccaactactgccagaaggtactctctaactacgtgagatcattaaacgattatcatgcagggattacgttttatcgtactgaaagtgcgtatatcccttacgtattgaagttaagtgaagatggtcatgtctttgtagtcgacgtacagactagccaaggggatatttacttaggggatgaaatccttgaagtagatggaatggggattcgtgaggctatcgaaagccttcgctttggacgagggagtgccacagactattctgctgcagttcgttccttgacatcgcgttccgccgcttttggagatgcggttccttcaggaattgccatgttgaaacttcgccgacccagtggtttgatccgttcgacaccggtccgttggcgttatactccagagcatatcggagatttttctttagttgctcctttgattcctgaacataaacctcaattacctacacaaagttgtgtgctattccgttccggggtaaattcacagtcttctagtagctctttattcagttcctacatggtgccttatttctgggaagaattgcgggttcaaaataagcagcgttttgacagtaatcaccatatagggagccgtaatggatttttacctacgtttggtcctattctttgggaacaagacaaggggccctatcgttcctatatctttaaagcaaaagattctcagggcaatccccatcgcataggatttttaagaatttcttcttatgtttggactgatttagaaggacttgaagaggatcataaggatagtccttgggagctctttggagagatcatcgatcatttggaaaaagagactgatgctttgattattgatcagacccataatcctggaggcagtgttttctatctctattcgttactatctatgttaacagatcatcctttagatactcctaaacatagaatgattttcactcaggatgaagtcagctcggctttgcactggcaagatctactagaagatgtcttcacagatgagcaggcagttgccgtgctaggggaaactatggaaggatattgcatggatatgcatgctgtagcctctcttcaaaacttctctcagagtgtcctttcttcctgggtttcaggtgatattaacctttcaaaacctatgcctttgctaggatttgcacaggttcgacctcatcctaaacatcaatatactaaacctttgtttatgttgatagacgaggatgacttctcttgtggagatttagcgcctgcaattttgaaggataatggccgcgctactctcattggaaagccaacagcaggagctggaggttttgtattccaagtcactttccctaaccgttctggaattaaaggtctttctttaacaggatctttagctgttaggaaagatggtgagtttattgaaaacttaggagtggctcctcatattgatttaggatttacctccagggatttgcaaacttccaggtttactgattacgttgaggcagtgaaaactatagttttaacttctttgtctgagaacgctaagaagagtgaagagcagacttctccgcaagagacgcctgaagttattcgagtctcttatcccacaacgacttctgcttcgtaaacgggacgtaatagaataatttttattattgctttaatatgcgcgcttccaatataagcattgtgaagcgcgtttcatatgtcttttatctttaggtaattattatgagaaaacttattttatgcaatcctagaggattttgctctggagttgtgcgcgctattcaagttgtagaggttgctttagaaaagtggggagctcctatctatgtaaaacatgagattgttcacaatcgccatgttgttaatgctttacgagccaagggagcgatctttgttgaagaacttgttgatgttcctgaaggtgagagagtcatttattcagctcatggaattcctccttcagttagagctgaagcaaaagcccgtaagcttattgatattgatgctacctgtggtttggttactaaggtgcattctgctgcgaagttatacgcaagtaaaggatacaaaatcatactgatcggccataagaagcacgttgaggtgattggtattgttggagaagttcctgaacacattactgttgtcgagaaggttgctgacgtcgaggccttaccttttagttctgatacacctttattttatattactcaaacgacgttgagtttggatgatgttcaggagatctcatcggctttgctaaagcgatatccctctatcattactctgcctagttcttcgatttgttatgcaaccacgaaccgtcaaaaagcattgcgttctgttttatctcgcgtgaattacgtctatgtggttggagatgtcaacagctcgaattccaatcgtcttcgcgaagtggctttgagaaggggagttcccgctgatttgatcaacaatcccgaggatattgatacgaacatcgtaaatcattctggagatatagcaatgactgcaggagcctcaactcccgaagacgtagttcaagcttgcattcgaaagctatcatcacttatccctggtttacaagtggaaaatgatatatttgctgtagaggatgtcgtatttcaattaccaaaagaactccgttgttcttaggtctttaggcttacttgccaagtttttctcgagattgctttatagagtcttcttctcgttcagagagggtatttacctttttagttctctgtatttgaaatatcctagattatttttttatgatcttggtaagtatgtctattctttaaggcattgcccttatgcaaagctcggtcgcttgccaggagcctctttattgaaagaaggaaacgtctacggagagactccatggtctgttcttgcaaagatctgtcaggcttttgatattacttctcaagacattctctatgatttgggatgcggcctaggaaaggtatgtttttggttctctcatgttgtgcggtgccaagttatagggattgataatcaaccccacttcattcgtttttcttcaaacatgcaccgcaagctctcttcaggattcgcgttattcgatactgaagagtttaagaacgtagttctctcacaagcttcttatgtctatttttatggttcttcgttttcacgacgcctgttaaatgagatcattcttaaattatcggagatggctccaggaagtgtagtcattagtatttccttccctttagactctttctcaagggggaaggaatgtttctttactgaaaagagctgctcggtgcgcttcccttggggaaagacaatagcatataaaaatattcgaaaaggctcttaattctactgatacagactgcgagcagcgtcatgttctgtttggagaatgttcagaaggaaattgtccatacttttccagttgtctttgacttcctcaatggtacgtgtgacttcatcctgtctcattctgaagacttcttttctgtactcagcaacagctcgtacagcactctctgataactcatgtactttagaagcggcttcagtaagttgtgatagagaggtgaaaacttttcctattcctttaaagaaggttttcgcagtcgcatctttgaatcttccagaaatcctttggacaaaccctaaaatgctatctccggaaatttctccaaccataggagcaatcgctcctaaaatacctaacgttgctgtcgcgatccctagccagcgggcgtatttagcttgacgtgaataactcgccgccaattcatgagcttccctttccatgagctctctttcttcaagacgtgtcattgtgtcgttagctctacttttgagcatcaacttcattagctctgtacatattctaaggacatcaaggttggtcacacgctttcctgcaagcacgcttagctgtgattcagacaaagcaaactccacaataggatcaggaataataggagtataagactcgtacacctggttcgaacttgaagtctgttgtagagattccacagtgcaccatggtgtctttttcttgccttcttcttgctcttgttcttgctcgtatccttcttgttgcctttgatctcgatgttcttcatctttttgttggctttttgtagaggatagtgcttgaggtacttccttatgtaaggtgctatagagtgacatcggactaagagtcgcatcagacttagtttgtgtgtgtttttgtgtctctgccgacttggtgctttgtgagactttttctttagcactatgttcttttatggtgctgctagaataggaccttacatgaaattgtgcttggctttgagaagcgcttgcttcttgttgctcttgtgcttttggtgtttggacagacactgtgaacgttttgtccacactggagtctccttcaggagctttgcatgagaaaaacggaaaggaagacgaggttgtttctgttgatgctttccctgtggaattcgaagatgtggattgctgcgctaagggatttctatgtgaagctaagctagtctgctgcgattgtcctggttttaggttcggcagagatgttgatcgcattaatatgccattttttactagaaattgctcttcttgtaatggtttttccttgggaggcagtgcttgtgtcaaagcacattccgattgtgttaaaatcccaaaacatagctcggaagttgctctcagcatcgcatattgctctcctgcagggagagctacttgtacttctgcagcaacaacagcttcttcagtggcatttccatctacaaaaatatcaaactctccttcaggaggaggagtcgatatggattggtaagatacagtcataatatttcttctgtggatttatcctcttaaggagtggagatacacttgatctagttcacgcatgtaatttaagattcttgaaagggcttcgaaagaactctccatgttatctaaaagttcttgagaacgttcgtaatgatcgtccctatcaaaacttttcaattcaatgtcgagttggattttagtgagttttcctttgagtttatagatttctgcttgagaaaacagtatagcgcatcttaaagcagccatcgtagattctatcgcgggttggattcctttaatagctccttctataataggggaaaaacctaaattttctacttttaatgtgcatatggagagaatgacaggggttaaatagacgacccactggattatggttataatttttcgtcttagttcttcattttttataggcagatgtttttctagccaatcccagaactttagtttctctaaacacttgataacaagagaaattagccctgcaaaaaaacctgcaaaagcaaagataccgcctccactcaagatagcaacaatgccgatccctatagaaacaaacggagctagccaaccgataatgtcagaaagagatccccataatctttctcgtttttctttctcgatgctgaccttgatagtctcgattctcttttcatgtagagcatcgagctctcgttgtgtcgactccacggaatctttgtggcatccatacgaagaaaagtctgaaagaatcccttgttttgtgagtagatagctcaatgtaaacactcctatgcttggaggaggaattacaggaacagcttgtgctgctttggctattctatttttacgtgatgtatcttgttggaaaggggatttcttttgtttttgattggaatcctgatcctgagaaaagaggtctttacagagatcttttatctgaactttggtttctatttttttctcagaactctgctggtttgcataggtttcactgcgctcttctcttcgtgattggaggagttcttgctgttcactatctaggctttgagaatatagcgagtcaacggttccaaacaacttgagatgttgttgtaggtgcagcgtatcaaaatttttgcaagagccttcttgtttagaactcaggtttttatctagagccttctctgaagttttctccggagattttggcatagtcagttcttgcatcagagctttacttgcttctgtgctatttttttgagaaaaaagattccaaggagatgaagtttgagcttgcgatgtgttgtgaagttgagattcgaaagagctgccgaaacgcaagattctctctcttggtgttgcaataatgaatgttttatgatgggtgataggaggctcagacttacattgtgactgaaatttctgagtgaaaaacttgggaagagacttttgagcttcttgaggcgctacagtgatagaatagctaatcttaggaaccgaagattcttgtgacctaggagcatcagggatataaggatcttgattgagaagaacctcacttgcttgagataaccaagaggacatagttgagtttccacattatttatgttttcgaatatctagaatttcttctttcaattcattatagaggggcttgtgttgtgcacgtacccacgccatttctaaagctttttcagcttcttcatgttcatttgtaagagtatagcatatgtaggcatagtaatgaggatagggatctttatctcgaaggactgcagtgactccataggcatgcaaagcttgtgaatattgttcggacatatgtagagaggcacctaaagaaaaccaaaacttagagacaaaaggattgaagaaaactaaccagcgaaaaacggtgatgcttttagcatagtctttgtcgagataggcgtgataaccctctttatatactttttcaagatcctcggaggatatcttgaagatcttttggtaggtatctaaagctatatttttatccgggacatatccttccaaatagctttccaaatcatctgggaaagggaagtcttccttggaagatgcagcgattttttctagtaaataatttaaatgtgacattaggggcgtaggttgtaaatgaaggtgtccataagttctttcaataacttcaatacattagagcgcgcttgatgacattgagaaatctcttggaggtgcctttgcatgtccgtcctttccatttgagtgattttctccatattctctttgcgcatttggacattctcttttagaagtcttttttcctcttctgtccaagtatatttttctttgtctatagtgactccaatctctttagctcgatttaaaagagctttcatctcttcattttcactccaatcaatgtctttcttttcattattgatcttagagataaggactgtgagtgtgtctacatcatcggtacgttgtttgactcgcatgtagagttcattagcttcggcttcggcttggcctaagattcttgccatgagcttcatgaaccttaagaacacattttctacttttggagtttgtataggcccgtgtattgaagagcctacagataacggattcttactagggatgaatctgctaaacacagacattggagaaggtagcttctttttgaatgtcgtttcttttttagaagtttcttcagcaggaggtcgcatttgatctgagaagattaaagcggcaatatctagattttctccgggttcctcagcgactgcctctacaccgagaccacgtttcttctttttctttttagattcagcgtcttcttcctgatcgtgctttctgtcgtgctgctctctttgttggcgatcttgatcgcgttctttatagagttcatgagattttgaggtcgtcagggcctctttttgtttctctgcagagaactgggatagaggagagaaggagcttgctttttgttgttctaatagtgttctttctggcgcactttcttgcggaggtaaggatctctgagaacttgagcttgcctgagataaggaagcgcgagcttgtgtctcaggtgacggtgcttcgctgtgttttcttacagcagagtcttttggtgtttgaagagcttgctgttgtttagaatcagaaatttcaggttttaaggagcgtggggagagagcagattgtttactgctgctttgttgagggagggtctgctcactcctactttgcgtttgtgtttcttgtggttcacttgtgattgtctctgcatgttccaattgcactagcaagtcaacaacttggatttctaattctacaacttcaggagggaggaagaggagttgatgaacatttgtgctttgtaagagcagttcttgttgggtcgcaagaatgatttgtcctaaagctaagctaattaaagcatctgtagaagagcttccttctagcgctgtacaagagactaagacttcacctgttgcagtctttaatattccagaggctgtggaaactgttgagctgtcttcttttagagttatatttgcagagggaactgcagaaggaacaggcatattcatgatttgtaatttgagtgcgtagaaaaaaaaggaaaattagctaaaacatcattttcctgcaagtttgattgtaagcggtttagagggaaagagaaaataaaacaaaaatccaagggtttttgtttgcaaaaaacactctaactatagagaataaatgggtcagtttcatgtctttgacaaagatgctctgcccaggtggtgaaattggtagacacgctggatttaggatccagtgctttcgggcatgtaggttcaagtcctatcctgggcatctccttttctaatctctttaaatccacctaaaatttgctattcgtagtaaaataaaatctaagggttagattttttagagatctttattatgaagaaagtcgtaacactatccattatatttttcgcaacgtattgtgcatcagagcttagtgctgtaactgtagtggctgtgcctttatcagaggctccagggaagattcaagttcgtcccgtcgttggtctgcaatttcaagaagaacagggttctgtgccctatagtttttattatccttatgactatgggtattactatccagagacttatggctatactaaaaatacaggtcaagaaagtcgcgaatgttatacccgatttgaagatggcacaattttttatgaatgcgattagagattcctggggtgatgggcaagaaacttctcgattagagaatccgcggctacgtgagtatacacttctgtagaggcgatgcgtgcgtgacctaacatctcttgaatgacgcgtaggtctgccttattgtctaatagatgtgtagcaaaggcgtgtcgtaaggagtggggagatacgggctttgaggtcacttgctttgcgtaattgtgaatacggcgccacacacaagagcgttcgagcttgtgtccccgggtagagaggaaaagatgatcttcgtgaggattctttttctggtattggtctcggaaaggacaaaggtacgcatcgatagcttctcttgctcgagatcccagaggcaccagtcgggttttagaacctttcccggtgacgcggatgcaatcatcagagacatggcctaaacgtaggtcacaaagttcagaaacccggacaccagttgaatatagtgtgtggagaatggctgtatcacgaaaggctaggtgtcgggggtttttctccatttggagaggaaccgcaagtagagcatcgacttcttgaggagtcagtactgaaggaaggcgtttccatatttttgggtgctctattattgggggatagggaagaagttgctgatcttttaagaagagaaaaaatacttttaaagcaatgagcctacgcgctaacgtagtctctgcttctttacgtctatatagttcttcagcaaagatatatacgctgttttgtgaaatatcttggggggagctaatggcacttatggtaaggaaggaagagatgtcttggcggtaagccgctatagattgttggcaaaggccgcgatctacagataaaaacaatgagaattgttctagaatcgttgtgtgaaactgagtcgagggcatagtcatactcgctaacgaatgtaactttagtatagggagcggagcaattttcaagctacagagagaaaaccatggaaagaaaaagatttatagattgcgattcaacaaagatactccaagagcttgctttaaatcccctagacctaacagctcccggggttttatctgcagagaggatcaagaagttttctttgctaggagggggatttacctttagctttgctaccgagcgtttggacgatgctattttagctgcattgatctcattagcagaagaaaggggattgcatgagtctatgttagcgatgcagcaggggcaggtcgtgaactatattgaagggtttccaagtgaaatgcgacctgctctgcacactgcaactcgggcatgggtaaccgacagttcatttacaggagaagctgaagatatcgccgtaagatctcgggtggaggcgcaacggcttaaggattttttaaccaaagtgcgcagccagttcacgaccatagtgcagataggaatcggagggtcggagctaggccctaaggcactctatcgggcccttcgtgcgtactgccctacagataagcacgtacatttcatatccaatatagatcctgacaatggcgccgaggtgttagataccatagattgtgctaaggctttggtagttgtagtatcgaagtcagggactacaatagagactgcagtgaatgaggccttttttgcagattatttcgcgaagaagggcttgtcatttaaggatcattttatagcagtcacttgtgaaggcagtcctatggatgatacgggtaagtatctagaggtctttcacctttgggagagcatcggaggaagattttcctctacctctatggttggaggtgttgttttaggttttgcttatggctttgaggtttttttgcaattacttcaaggagcctcagctatggatcaaattgctttgcaaccgaacgctagggagaatctccctatgctttcagctttgattagcatttggaatcgaaatttcttaggctatcccacagaagctgtcattccttattcttcaggtttggagtttttcccggcgcatttgcagcagtgttgcatggaatctaacgggaaaagcattgcccaagatggtagaagggtaggattttctacgagccctgtcatttggggtgagccgggaaccaacggacagcattcttttttccaatgccttcatcagggtacagacattattcctgtagagtttataggttttgaaaagagccaaaagggtgaggatatctcatttcaaggaactacatcttcacaaaagctttttgccaatatgattgctcaggcgattgccttagcatgtggctctgaaaatacaaatccgaataagaattttgatggaaaccgtccttcttcggttttagtgtctagccagctgaatccgtattctcttggggaattactttcttactatgagaataaaatcgtatttcaagggctctgttgggggattaattcttttgatcaggaaggggtctccttgggtaaggcattggcaaaccgtgttttagagttgcttgagggggcggatgcttccaatttccctgaagctgcatcgttgttaacgctttttaacatcaagtttaggtaaaaattacactatcctttcataagtctacctcagagagaggtttttcttaaggttctttattgtccgtctgtgatataatgctcctttggatttggaaaaatttgtgaggataggatgtttttcattgcagtacgctctcgtggatttttagatattcatggtattttagccgctcgtaagggtaagcaagtagtgaaatctactgcgggcgcatggatagggtctcgtggcgccgtattctacagcctggtttcgtaattttaaataaaatattccgtatctttgttgaaatatgccaggttctgtgtcatcacctcctttgtctcctgtaattgtccgtgaaagggtcccatcctcttcaggatccgacctcatacagcctcatgctgttttaaagatctccatcctaatttttgcgcttgtgacaattttaggaattgttcttgtagtgttgtctagtgctttaggagctcttcctagtttagttttgacggtttctggttgtattgcaatagctgtaggcctgattggtttagggattcttgtgacacggctgattctctctacgatcagaaaagtagatgccatgggttatgatgctgcggtcaaagaagagcagtatttgtcacgtatcagagaattagagtctgaaaatagagagattagagatagaaatcgtgctgtcgaagatcagtgtgcccatttatccgaagagaacaaggaccttagggatcccgaatatctacatggaatgactgaaaggctcattgcgagcttagaaatagagaatcaagctctcgtagctgagaacattcttctcaaagactggaatgcaagcctatctagagatttccgcgcatataagcaaaaatttcctcttggggcattagaaccctggaaagaagatattgcatgtatcatggaacaaaatctctttttaaaaccggaatgtatcgcgatggttaagtctcttccattagagacgcaacggctgtttttatatccaaaaggatttcagtctttagttaatcgatttgctccgcggtctcgctttttccagactccaaagtatgaatataacagtaggaatgaaaatgaggacggaaaggtagccgcagtgtgcgcccgtttgaaaaaagaattcttcagtgctgttttaggagcctgtagttacgaagaactagggggcatttgtgaaagagcagtagcacttaaagagacgttgccattgcctgaagctgtctatgataccctagttcaggagttcccaaatcttcttactgctgagagtttatggaaagaatggtgcttctattcctatccctaccttcgtccctatctttctgtggattactgtaagaggttatttgtacaactttttgaggaactctgcctaaagctttttacaacgggatctccagaagaccaagctttggttcgccttttctcttactataggaatcatattcccgcagtcttggcctcatttggtttgcccccgcctgagacaggggggtctgtatttgtattgctaccaaaacaagaaaaccttctttggagtcaaattgaggtgctggctacaaggtatctcaaagataccttcgtgagaaactcagaatggacgggctctttcgagatgatgttttcttataacgagatgtgtaaggagatctccgaaggaaggattcgttttgctgaagactatgaaacgaggcattccgaagaattccctccttcccctctctctgaagaaggagagggcgaagaattccttcctccttgctctgaagaagaggtttcggttcttgagcgcccagatctagatgtagactctatgtgggtctggcatccgccggtccctaagggacctctttaatcacctagagttctattttcagaatcttcatagtagtaattttcctaagatataaggtcttaaatgagttctagaggttttaggatctttttggagagcttgttgtgggtttaaaatcttgataagaagatatcctagtgtttagaaacccaaaaatttagggtttgatgaattggagtctcgaaacgacttttttttcaatttcttgttttgtttctacttaaagactatagtgattttttttgaagggggtgcgtatggcattcaaagaggtcgttcgtgttgctgtcacaggaggcaaagggcagattgcgtataattttttatttgcattagcccatggagatgtttttggagtggatcgtggtgtagatttacggatctatgatgtgccgggtacagagagagctctctcaggggtgcgtatggagctcgatgacggtgcatatcctcttttacatcgtctgcgtgtgacgacatcgttaaacgacgcttttgatggtatcgatgcggcgtttctgataggtgctgtgcctcgtggacccggtatggagcgaggagatcttttaaagcaaaatggtcagatcttttcgttacagggggccgctttaaatacagcagcaaaaagagatgctaagatttttgttgtagggaaccctgtcaatacgaattgctggattgctatgaaacatgctcccagattgcatcggaaaaatttccatgcgatgttacgcttggatcagaatcgcatgcatagcatgctcgctcatcgtgctgaggttcctctagaggaggtctcccgtgttgtcatctggggaaatcattctgcaaagcaggttcctgacttcacacaagcacgtatctcagggaaacccgcagccgaggttatcggagatcgagattggttggaaaacattttagtacactccgtgcagaatcgtggaagcgctgtaattgaagcaagagggaaatcttcggcagcatccgcatctcgagcacttgccgaggccgcgcgatctattttttgtcctaaaagtgacgagtggttttcttctggagtgtgttcggatcataatccttatggtattcctgaagacttgatttttggttttccatgtcgtatgttgccttctggagattatgaaatcattcctggattgccttgggagccttttatcagaaataagattcaaatttccctggatgaaattgctcaggaaaaagctagcgtgtcttcgttataagcacaatgttgtggggagtaagtatgagacaatcattcgatgaattaagtcaaaatgcatttaaaaatatttttaataaacagaggttctgctttattttctgcagtctctgttgctttggttttgtgtttgcattgtttctgaagctctgctcacggctggctcctgaaatttctttgtcgacattaggtttgggagcttttttctgtgcctttagtgtgatttgcgcttcagcgattatcgtgcaatttttattgcataaggagtctcaaggagaaacgagtaagctctgctgtgctattaagaacacctggtcttccttatggctttctcttcttgtatcgatgccgttcttcattgctatggtcgccgtagtcactgtagctatgctctcttcttttttaggatctcttccttgggtgggtaagttattccatacagtgttgattttcattccttatctatcggcaacggcactgattttactttttttaggttcttttagctgtttgtttttctgcattccggttctccataatcaagagtctatagactataggaaattgctagagtgttttcgtgggaatatccttcggcagtttataggggtggtgattgctttggttcctttagccctatgcagttggttagctttagattctttttatttgatgacacatcttgttgaaattgcagatatacatacctggtcatttctagctcagatgtttgtgcttattgttcctattgctttgattttaactcctgcggtttccttcttctttaacttttcttttagcttttaccttgcaaagcaagaagaagagaaagcccttgttaaatagtaaatagaaattctttagcaatataagctgtagattttcgtagaactgcctgagcgagcatgtctcctgtaatcccgtgatacaggagtcctttcgacccgagtcctcctaagaaccagagtttttccctaatcctagagatgacaggaagacgtgatttgctagaagagcgcatgccagcataacagtgcaggacttgagcatctttaagtcctggaaatagcgagagcacaggaggcatgatttcctgataggcaatagcgggatcaggagtctcttcgggttggttgtgttcgaaagtcgcccctaaaatgcaggtattcttttgtgtattggcgaccatatatttatgagcattgatactgaatgagagcatggcaagatctttaggccaactgatctccagcaactgtccttttactttatttaccggcatgtctttaagttcaggaagaatcgaggcgttggctcctggagtcactatgatatgatcatagaactcttcaatatcggcaaggtcctcaatgagctcatcatagaattgtgtccctaatttcatgcaggcgtcagccaatccctgaatatagagatcattatttagagttaccccactctttatgaatagtgctccgagatttggggggatgaccatactgggaatggagatttcgcaacgagccttctcccaccattcgacttctttggggaattcttcaacacgctccgtgaatagctgagcttgatcctcgtcaattgccggtcttaagatcccttgagaaatcacaataggtacgttgagggctttactagcttctgtgattaacgcgtgtgtagcattgattccttgatctgccaggggaggcttgagagcttttttccccgtgaaagcatggaggagtcctgaagacattccagaggctccttctcctaagggaataggatcaaagagatcgatagttgcagtcccctgggagtggagaagcagatgccaagttacagagagtcctgcatatcctgctcctaaaacggctatacgcataaagtgtaccttaaatcaagtatcgttacatagaccttgtcttgagaataagagaataagggataaaagaacaggggggaatctctctgattgggagataaaaatgtagaagatgaaaacctgattcttaagggtgaattttttactatagagaagagaattagggagacccccacggcataagccgtggggaaggatgaaagtttaattaaattttgattcttcctgttaagaataggaagatcgctgtcagtgcaagaaggcctatgaaagtcattcctacaatttcttttttagcaaagaatgtcttagcatttttcttctttttccctgcgtctatatagaaggggatgccaagagctaaaagaactaaggccataaagaggtattttagacctcctgcatagataagccatagagagtaaaccactcccaggataccagttatcattgccaaaggggctttaatagacccttttttaggatatgttttgcttttgctaagtttaaagagaaaggcagcactcgctagatacgcagggagaaccatgacccccgtgatgctgagcatagtattccaagcattcgaagaaaagtaaacaaggagcatggcgagctgcatcacagagctcgtaatgtatagggagacgctgggagatttctctttattttctatagtgaagatctcagggaaggtgccatttttagctgctgagaaggggatttctgcaacgatgatcgtccaggataaccagctagataaaacagcaataatcaggccgacattcatgagcacttctccccatttccctacgaggatgtcgaggacaccagctgtagagggattggggatgttcgctagttgatgttggaagagcgagccaaaaggtaataaagaaaataagatgtagattgttaggcaacctaaaaatcctaagactgtagcttgccctacagagagaggattttttgctcgtccagacatcaccacggcaccttcgattcctataaatgcccatagggtgaccaacatagtccctttaagttgtgaacttacggatcctaaactcggttgggcttttgttacggcatgtccccaaaaatctgttttgaaaacagcgagcttgaagaagaacgcagtcaggataatgaagatgattagagggatgattttaaatatagttccgatgacgttgattatcgatgcttgacggattcctttcagaactatgaagttgaacacccagataagaatggagcctcctaaaatagcaggtagggtatttcctccttggaagtagggagggaagaagtagtttagagcatccatagtaattacggcatatcccacattaccgaagatttgacaaagccaatatccccagccgatggtgaatcctatgtaggggccgaaaccttctctactgtacatgtagatcccttccttaaggtcgggacgtattgtagagaggatcctaaacgtatttgcgataaagaacatgccgaagccagtgagtatccaagataggattacggcaccagctcctgctgtcgctgccatgttttgggggaggctgaaaatccctcccccaattatggaactgactaccatacccgcaagggctatggtccctaaattttttgaggatttagtccttgaggtcatgaaagtctccttaatttaccttagctggttcagcattttcgaaatttaggaatcctaatgcagttaagcaaaaaccgaatttttgtttgatgttgatgtaattatggaagaattggaattcgctatgctttgctatagagcgtaggtcaagttcgtgttgtagggattttttcaaccacattttagcatgggtttctgcaatttcgtcatttatccatgtagggaagaattcaacatattctgctgcccatccgccaataagctctccatttttatctttaccccagcaaatgccgattccggtggcgatcgcatgggttccgtcagagagagcagcaccacgacccgccatgattacttcaaggacagcgccgtgtttgaaagattttacacaggtatctacaggaacgatattcccaaagagctctttaggaagtacagatgtataagggacgatattaaaattttcgatttttgcttgtagaagagcagaatcgtagcagaaagtttcaaagggttgtgggggcataccgtcatcagattcaccaatgccccctgtatggaatgctagcgtgggataacgagttccgtaagccataagttactcctaaataatattggtgtggttttgttataaggaaagatttgcacgcaggccatacacttgagaggttctcctctctgggcgtaacgctgggtggatatagagttggaaatctggagttagagatatataaggtccaaagccaatagtagcgaaagcttccataacagactcataacgtcgtagcttgttcacattggaaatcgctttagcatttaccttatttgtagcaaatcctatgccaagaagatcttgagagtggcggtttaagggattctcagagacaagacctaaaacatacgaacggtttatggggagtgctgttcccgtagctccgttgattcttccgaatagatagagcttttcatgaatatgttgagcagcattcagggaccatcctgtgacctgggagttttgctcaggaactttgcgtgtgctatagagcaatacagagtactgtccatctccacacgaaggttttggagtccaggaggcgtagccgtaaaagttgtatttgctttttgtcagattataaatcgaaaagttggttccatcaatattataggaatcttgaaaacctagttgaaccttgatttcagaatttggagtgaactgcagataagcacctgtacttcccaatgagtaggtagcacttgcgttttgtgataaggcgtagctaataaacccagagtactgatcattatcgtaaagcgtgccgtctatagcatagaggctgtattgtcctatagctagggtcaaaaagtctccagggaaagtctgagagaaggtaagctgtgctaggttattttctctattagagtaatcattcatactggaagcggttcccgcggcttgattggcgtcaacaccgttagtttgccagtaatgtatcaacgtatagctaaagtctacgattccttgacctgctgttggagaatcataaagagtccaggtagtgctaggactgaagtagaactgccacgaaggaatctctagggcttgcgtttggccaagagctttgtgagggtaaaaccactggggaagaatactgaagtccaaggatatctgagtatttgtcgctttttctacagatgttaataggttggatacggaaatgccatccttccaaggatgtgaacagaagatattagtaactggagagagaaggctgttatgatgtggagtttccgaaggggcgctttcttttatggactcgggatgttttttttgaattcttgctttataacgatggtagtggcccgtcgtttctttaggagtttcggcataagaggaaattccaagagcgcagagtcctgaaagtaaaagaaaacgaaaggatatcatgaattccccgtagaagaaggcatagtgtttttttttgactctaaaaaaaagaattgtttttatgtagcaaaaattttcttctgaggggaggaatgctatggaatccacagtatcagtcgttaagaattctcctgagtagtcttttttcttattattctaaaattattttttattgagatcgagaacccacaaaagtaaacgtcagggagtgcttatctttaagaaggattattcgtgcatttggtggcgcagaagaagagccgccgcttcattgctgagtaattttttagagtagttgtactgtacttgtgcaatgttatcaaaatagatcggggggtgaagttcctgagctttataggtgattccgaaataagcaattccatatttttggcatagatcaccgatgcgaaggacattttctttttggttatcaatatagataatcttagcgggtaagggggtgcatatttccaagaagagatcgagtcccggtcctttgtggtagtctccagaaaaaagaattcccgatgtgtagagaaggttcttgggtaggggagcttgaggttgtggagcagtatcttctaaggagacgttgagcatatgaagttgctttagggtaagatctttagctgttttaggacgttccgtgtagacaaaggttgtctttccttgcttctggattttctcaatgagtagaaaaatagcagattctataggctgaacggttcccatttcttgaatttcaatccagaaaggaactacagcctcccaagcttcttgttctggggttccctgtttctgtaacccctggattgctttgcttttccatatagaatgagagagagcctctcctccttgaagaagcgtatcatcaagatctaagatcagccagaagttctcttcatcatagaggatatcaccagcaacttcatgaatggacctgacctcggcataacgacaagaagcatagaacgacgagcaggagaataagaaagtgaagaacaaccaggttttcataacgtaccttgcaatcttttggacaaggatagagtaagacaagtattttttatacttttgccatgaagttttttacatagtttcggaaagagtcacaagactctggagttaggaaatctgggaaccaaagagcaaattgtagcagggcttgttctatgaacatttcgtagccatggataatgagagagccatgtttttgagcacgttcaaggtagggagagggatgcggtttggtattgatgtccatgactataggagggaatctccaagggaaggtcacttccggagggagacagttgatgattatgtctatagttttaaaattctctaaggagcctaagggataggctttgcctttacagcaagtagctaaagcagctgctgaagaaagagttctattgaagatgtggagattagcaccttgcatcgccagtgttgcagcgattgctttagcagcacctccagcacctacaatggcaatgtgtttgttgttaacagagatattcttttgttttaggagtttggctactccctcaccgtctgtattgtaacctagaattttctgatttcggaagaccagggtgtttatagactcgcagagttgcgccgatgcatcaagagcatcgacatggtcgaagattgcggtttttagtggcatagtgacactaagtcctgaaaaaggaagatctcggatcgcagagaaaaaggtgacgacttcccctatagtaacagggaatttgatatatgttgcattgagagaaagcttagagagtaagaagttgtgggagaggtgactgatgctacggtctacaggatctccgatgagtccgtaaatgtgtgatttttcagatagcttcgagtagttataggagagcagctcctcaagtttaggttgtcccggggctacttgaggcgcactgattccagcagcgtaattcatagcgttgctgatcagtggggagagaactctagaggggagcccatgggttcccatacaaaggactgtagatggttttggtaacaggcgagctttttttatataattcagagcttcactggagttctctggggagagtacgattttgtagatctcagcgggagttgcaagcatctcattatagattgcatcgaggtcttcatttttgtctgtatgataggaaaggatgagctttattttaggatggctcttgcggatggtttgaagggcggtcttaggaagactcacatcgatatccatccacttgggttcaagttttgctagggaatatagtttttgaatccatagcgctgtcgacatctctttgtgttgtctaaaggtgaggatggggttttgggctgtggtaatgagggtatgcagttcttgatcatcaagttcgtttatgagatcgagtcgtagttctataatatctacaaggtgtagagactttagaatttgttgttttgcttcacaaaatgagggaccgctaacagtggcgcataacatgacactcactccatagtatatcatagagaatctccatatttggagatgcacaataggtaccattaaagggagctgcacgacctagatgctctatcatgatcatttttagttcgtgttgagaaagattttttttatcgtatcctaaagtgtagatgatattttcaggactatacaagctgttgtggagatgttccggaacaatagattgtaaatctttcaaagtagaagggagattaaatcgttttaggagtctttcaagttggtctatgagttgtggggttttcataactccttcagcaagagatattcttgtttctatcatcataccgacacttacggcttggccatgatttaccgttccttttgccagggtttctatagcgtgggctatggagtgaccgaagtttaggatttttctcagacttcggtcatagggatcttcagcgacaatcgccgctttgatttggcagtttcttttgatgaactcgtggaggatctgcgatgaagaaaatagcattttactatggctatttagaaattcccagagataagcatccgcgatgaatccatgttttattgcttctgcaattccatgataccattcttctcttgggagtgtagagaggaactgaggacacatccatacttccttgggtaagtagaatgtccccagtcgatttttgattcctcgtaagttgattccatttttccccccgatactcgtatctaccattgcggtgatcgtcgtgggaattagatatagagggagccctcgacaatatgtagcagctaaaaatcctgtcatatctaaaacagtcccccctccaattccaataattgaagatttcggagagatattctgatctacaagctgatattgtagagatatgaatgtttcccaggttttgttaggttctccaggaggaaaggttaggacaatgacttgatatcctaacattttaatatggtctaagataggacctaggagatgctgttgtactgaaacgtctgtaataatgactaagggatacgctgtggatatagaagagaacaacttcttctggaagaagttggatatgagtttcactacatggggagtcgtaattattgtctctgacatcatagtttggagcatcgttggtataatacaagatctgcaagaacaaggtttatcatagcctcaacaacagggacagcgcgtatggcgacacaaggatcatgacgtcctgtttgaggtgtcctataggtagtttctttttttgtctttgtcactgtagcacagggtcgctttatcgaagaggtaggtttaaatgctatgcgcccttctataggaactcctatagttatgcctcctagtgtgcctccacagttgttagacttcaaggtaatgttttctccttccatgacgaagggatcagtatattgtgaacctctcatttgagcagaggcaaacccttttcctatttcgaatcctttagcggcggggatgctcattaaagcacttgctaagagggcgtgcactttcccaaagaggggttcccctagaaagtcgtggattggagacgttatgaaagaaatcaccccacctagagaatcagagtcgtcgtgtagagaagtaaggatctcttggattttctcattaggtaacggtgaatagaatggcgaggtgtgaatcttgtggatgagctcgggggagatcttcaggtagtgagggagggttagagatcctaacgaggagaggtaggctaaagtaaaaatgttttgattcgcgaggaatttctctgcaactacgccagcagcgacgcgacatgccgtctctcgagctgaggagcgacctcctccgttaggatctacaattccgaatttcttttcataggtatattgggagtggccaggacggtagagcctttcactgttttcataaggggagctatctacgtcagtattgaggatttgcagggataggggagtgcctgtggtctttcctttataaactccagagaggatttgcacgatatcgttttctttgcgcgatgaggttcctggatttcctggacgacggcgcttcatggcaggaacaaaatctgattcatggagctcgagtcctgcgggacaaccatcgattacaactccgattgagggaccgtgggattctccccatgttgtaaaagaaaacaaagagccaaagctatttttcatgactttaacaaggtaatgagatcttgagacgcttgttctaaggagctcttcgaggaatgatctacgtgatccacgggaaaaatgtaatcagcaatttctttcattctgtcgatgcgctcagttaaaatctcgcttagaggttttgttttcatggcttctttcagccgttctggtaaccctcgtttctcgagtctttcataaattaaaggtagttctacagagagaaatacaagagctcccctagtttgaatcgctcggtaagaggcttcatacatcaaggtccctccaccaagggagatcaaggcatcttctggaggtaaagtttcaagaatacgagcttcacattcactgaatttctgatccccataagctttatagatctctgcagatgaggagtatagtgcactgctgtagttgcttacaattaaatcatcaagatcataaaaaggaaggtttagaaatttagccaaagctttcccgagcgaagactttccgcttgtgggtagaccacatagaataattgtcatgacattcctcaattcgagcttccattatatttagagtctgaacgaagttaggaaaggttttcctaacgcacgcagtgttgtgaatacgactatcgccagaagcatatagagctgctatggtcaaggccatggcaattctatgatcatcgtgagagtccaaaacagcaccgtagaggggactgggattcaccagtaagccatcatgagttggctgtatgcatgctcccattttctgtagttcttcggtgattgcaagaatgcgatcgctttccttgtctttagcactgcgtgcattgtagaggtgcgaaggggaatctgcaaaacaacaaaggactgtgagaatgggaagagcatcgatacaaccatccatatctatagagccaccagagaacgacgaagggaatactaagatctcttcgttgtcgtactgtatagaggctcctaagttttgcatgagagaaaaaaagattttgtctccttggatatctaagatgtccaagttacgaagacgtatcggttggagtgattttgaaagtagagcagctgcagcaatgaaagctgcgctgctgaaatcaccagttacgtggtaagagaaaccttgaggatgtgaacttcccgggaaagaataggtagtatcagaacaagaatagggaagatggagtttctctaaccaccagagactaagatcaaaccatggacgctctttcggttctatgatagtaaaggaacagggaccttcggctaacgaacatgctacggctagtgctgaggcaaattgagaatcactaccttcaacatcgctataagcagagcgtaacggtcctgacattgtgaaaggtagaacgcttttatctgaagagaaatgaaacgaagctccaaagtttctcaaggcttgaagtagaggggccataggacgccgttgcaactgtgacgatcctgtgacggtgatttctttagagaagacacaggcaagggcagtcataaaacgcaacacgataccagaatttccagcgtctatgagagtatattttggaaatatagccaagggattgcccacaatttccaaaatttgagggaatttctttatagaagctcccatctgcttgcaagcacaaatcatagcctcagtatcaggagaatctaaataattataaattatagattttccctcggcaacagaagcccatagaatggctcttagagtatgggactttgaggaaggaatgaaggcgttcccatacacagaagaaggtgaaactttataagtaagcattgtaaagcaaacttatctctttttttttaggtaatttgcctgacttctgatttgtcgtctaagaaaaattctagaactttgtaaaagtcgaggaaggatcgaagatcatttgttctaatctctctacaaactgcaagcaaagctccccttcgaattggcaagcatagcctaagagttcctccccgtgggggagatctttaagttcacgttccatctcttgcagatggccttgctcttctaagataatggattttaccgttattttactttgagcttctttcagaatatcgtgatacagaggataaagttcagaagcacgaagttcgattgcgtaggtaactaaaatatacgctgcagtttttaacgtttgtcccgatagggagtattcattttccagtactcggcacgtccttaaatctagaagatggaggtaatattttgtaagtaagcctcccagaagatttttagatgtatagtcagggagagaagtctctgagattctagaaatctgagtttttagatagtgaccatgacgaaattcttcagcagcatgttttaaaacttcttcctttacctccgtaggatgttcacttgcggagattttttttgctccactattttctaaaaaggacagggtatttatccattgtgcatgccaatagttggaagctacgatctctttgagaacgggctcccaacgagaggctgtgtggataaagtgttttactgtggttgtagacatagggcatcctgtaggtgagaataaataatccggagatcttcttcttggatacagtaggggggcagcacatacagtgtgttccctaaaggacgaagaaggactccacgttctaagaaaaagcgattgagatggtctctatattgtgaaaaatatcctgtagcttctgcagggtaatctagagcgagtaccgtgcccagaacctcacaccgttgccatagggaaccatgagcttcttgaaactcttgatgacaccgttctatcatttgcctttgttgtaggcattctggagatagggtgagatccaaagaagcgagggcagcactacagcctaaaggatttcctgtgaaggtatggccatgaagcagtgccttcatccgatcttgggagacaaaggcatcatgaatttctttagtggttactgtcaaggctagagggagatagcctcctgtaagacctttagaaagacagataatgtcaggaggaatgtctgtaaattcagaagcaaacagtggacccgtacggccaaagccagtaagaatttcatcagcaatacagagaaccccgtaatgcttggcaagcttgagaatctcctttaggccttcgggattatacattaacatccctccagcaccttgcaatagcggctcatagataaacgctgcgatattgctttcagaaaagactgtttttgcttgggcaatggcaagctcttccttgccataatagggagcagcaattgtactggaaggaagaaaaagatcatgaaagggaactgtagtagggctcgtgccagctatcgacatagctccaaatgtatctccgtgataggcattgctgagtccaacaaaatggctcttagccttgttttgattgtagtaatattgcacagcaattttcattgctatttcgatagacgttgatccgttgtcagagaaaaagaaacgttctagaccttcaggaaggaggggagcgagtttcgatacgagctctagagccggttcatgggtgaaatttgcgaagatcacatgttctaacttctgtgcttgctcacataatttttttgtaatgtagggatgcccatgaccgtggaggttgcaccaccatgaagatatcgcatcaagatatcttgttcctgattccgcatagaggtaagcaccttctccccttacaatctttatgggtgtagaatctaatgcagattgagtgaaggggtgccagatacaccctgaattccctgatgattgcttgtccatacttccttccattgttcggcataacagcttatgattgtctttgtgatttctttttccttggcaagagtcccgattataggaagcttgatttcttgagttagccagtgctcttcgtcctctggatacccatttaccaccatacctaagatattgaggtttcgtgagcgcattgcttctaccgttaaacaggtgtgattgatacttccgagatatgcttggctcactaaaatccaagaacatgaccaagaagaaaacacatctccctgaagtctttttgatgtgcagggggataaaaatcctcctgaagtctcaataatcagattcgaagttgtttttggcgcacaaatatgactctcttcgatacttacattatcgatttgcgctgccttgtgtggagacaagggcttatgcaatcgataagcttcgggatgacagtaggctcccgatagctcatgaacaatattgctatctgaattttctagattccctgcttgtataggtttccagtattctgcgttaagtgctctagcaaggatagcactgacaatggtttttcctacgccagtgtcgattcctacaatgatgatacgttgcataaaaaaatttgctctaaagtatgtaaaaggtgatctatttcattttttgtattgaaggcatgaaggcaaatacgtaacagttcttctctttgttttactgttgggctcacgatagggcgaacatcgtaccctgagttttgtatttgcaatgcggcttgccgagcacgatggctccctgaaacacaaatagattgtataggtgtagtagtattgtctttcattagctgaagtcccaagttttgagctttttcgcgaaaatgatgaatgagagcagaaagatgttcacgttgattaaaagcacgttggttatgctcataagcgagctctatagctgtgagcgcatggggaggttgggctgtggtgtatatgaaaggtctacaaaaattaattaggtagtctttgagtatagaacttcctgcaatagcagcgccatgagtgcctagagcttttccaaaagtatagacggtggctaggactttatcttgaagacctaatgcagagacaaggccttcgccctgatctccaaaaactccgactgcatgggcttcgtcaacgatcaggtaagcggaatatctttcacagagttcactgatagcttgtaaaggagccacggagccatgaagcgagtatacggattccacgcaaacaaaggttcttcctagatgggagcttgctaaacgtttttctaagtgattcagatcattgtgattaaagggaaagctttgagctttgcttaatcggatgccatcataaatagaagcatggatataaaggtcgtgaagaatacgatcctggtcggtggcaagagcatagagcaagcctaagtttgctgtgtaacctgtattgaagatcaaacagctttcaaaattatgataagcggctagttgttcttctatacgctgacagagttgcgagtgccctgtgagaagccgagaccctgtagctccaagcgattctatcgcatggagcttggtaatgtattctttccttaattctggagaagaggcaaatccaagataatcattagaggtaaaatcaatgagatgagagtttaagcttagcgagcggtaggtatgtttggacttacgtcttgccaaagcctcaattaggaattgttggcataacatgggttacctctttctattccaaatgaagggcgagggattaagcctaaaagtttgatcatttcagcatcttcatctatatcattgttttctacagtcaacagtttatctccatagaatatggagttggcaccggctagaaaacataaggtttgttgttctactgtgaggaaagcgcgtcctgcagcaagtcgtaccatggatctggggaaaacaacccgtgccgttgctatggttcgcaagacttcccagaaagaaatcggaggctggtcttgcaaaggcgtgccgtcaatcggccaaagtaaatttacaggtacggattctgggatatgatctcttgttgcaagaacatgaagaagctttatacggtcttcttcagattctcccatacctacaataccaccgcagcatgtactaatgccagatttatttactacatcaagagtgttgaggcgatcttcataagaacgtgttgtgattatagtttcatagaattccggagaagagtctaaattatgattgtaggcataaagtcctgcatcatacagttttttagcttgctcttcggagagcatgcctaaagcacaacaaacctcggctccgagatctgtgatacttttcaccatagcgaggactctatcaaagtatcgatcgtccttagcattgcgccaggcagccccaagacacacacgagtggcgcctagctctacagcacgttttgccctttccacaacgtctacaattttcatcataggttctggtgtgacgtgggtatgatagcgggaagattgggcacagtaggcgcaatcttcaacgcatccaccagttttaatcgaaatcagatagcaagtctgcagttctgaatggaggaaattactacgcaatatggcattggctttgtgaatcagctcaaatacgggagtgtgataaatttcgcggatgtcttctaatgaccaggatacagtttcttcacgcatgtgttttgcctagggggtaaattcaacgaccgagcctaagatatttacatggaatttagagaaagtcaataggaaccaatttttggttcctattttttatggtatgatttgagaattattctaataaaataagagaaattacgttttttaataaagcagctctatttttaaaaaattagaaataatcatgaattatttcttgttgtctaaggttgatttatcagaggaactgtatttgcaattttagtagaaggcatccctaaaaacttgcggattgtattcacagcgagataaaagagcggtgtcgtgagaacacaaaaagtaattttataaatgtaagagtagaacataatatttagggtttgggggaaagaaagccccatgccgaaatataaaatacaggtgtcgacaatgaaagtatctggaatttgtgagatccatgtagacccattgctacgtagccatagagatgaattgggagttcgatttttaaaaaaagtgtaaaggacgatgtctaattgctgagagacaatgaaagcaagtagtgaagctagaaaacggagaggacttaaatcaaacaagcagtgccaggcagtttgcatctcaggagaggctactgggaagaacataaaaatttgtacaattgaagaagctaagaggttggcgataaaagctgaaaatatcatgacacgagcttttttagggccaaagatttcgttaacaacgtctgagatgagaaacgtcaggggataaagaatgagtcccccaggaataatgaagttaaaaaaagtcgttggaatgagcttcgaagagaggacaagattggagagaacaagaagcaaagtaaaggttgaagacaagtaggaaaatactaatgtttttctgtgggatgtattcattggcaaagtacctcaaaaccagaaagatatttctcttgattgtaaaggggaattgattctaacagaccttggtcgagcatccattctaattttgaagtgagttctaccagttcatcaaaatgtcttattgaaaataaagtctcttgtggagttgatgtattgaagggaagacgaataatctgatccaattctaaagggagaacacgtacgttatcaatgaaagcgtgtccaagttcctgaggagaactgataagaacggctccatatgcttttcttccttcatggttttcaataagtccgctttcaacagtaaaccaaaagcagcgtacaatagcgatcagattgctttgtagggtttgtatgcgttgttttttactaggaagagcttgtactttttctatgactttagtgaagagtcttcccatgtttatgaaaaattcagaaaatgagggatgtagaagccaaggcacgtgccctaaaaggtcatggatgagatcaggagttaaggagaaattatctttatcgagagttcgcattacagaggcaatgggaaagtaacggtcctgcaacagagacaagtattgatggggagctacaaatcctgaaacgggataataggaaaaatgtgtttctaattcgaagaatttaatgactgcttgatggtctaagaaatcagaaaggagaccgaaagcttctaagtaatcaagaaaaaatcttggacaatagcttttccatagagaaaaccgtgaggaaaggagtcgataccataaattccgattaaaaaagggagtgcttacaacagccatatcagtggagcaaccttccctttgattctttgataatgacagaagatgaacaaagagtaagtttttgaaaaattctaaaatagaaatgcatttgtgtcgagctaaagcttgcttctctttattttccttttgtagaatgattcggtagtaggaatatggggtcgagtatgcacgttggagtgattggctgttctggaagaacagggaaagtgattgtctcagctttagagcaatcttcagaatatactttgggtccagggttctctcgcagtagtgcactcactctttttcaagtgattgcacataacgatgttcttgttgatttttcccaccccttactaactaaagaagtcgttgcccatctcttaatctctcctaaacccctcattatcggaactacagggttccctgggaagtgtaaagaagctcatgacagtctcgaagagctgactcacatcgttcctgtagtggtttgtccaaatgcaagtctaggagcttatatacacaagcggcttgtaatgttgctatcgcaattatgtaacccacagtttgatattcgcattcgcgagactcatcatagatataagaaggactctctctcaggaacagctcaagatttacttgatactatacagcaagtaaaacaagaggattggggagaggagtatgaggtaggccagcgagattcttctaagaagacgatagaagtgcaatcttcacgagttggagatatccctggagaacatgaggtcgcttttatcagttctggagagcaaattttggttcgccacacagtattttctcgcaatgtttttggtcggggaatcctttctattttagattggctaaaaacattgaatccccaacctggtttgtatagtcttggggatactttggagctagtcttacgaaatgaacattgcttgcttaaaaagacaacggatcattaatatgcagatataaagatcttttgcgtcgtaaaatcctgatcttcaaattaggaatgtagggtgccgcaattacacaacttcgtgtacaaaattttaagcgaggactgttttgatttttagcatcgataggaccatcggttaaattaggaagtgttgacaggcaattcaaaaggaatcattgcatgtctgtaaacactagagatagggttatcgtgcattccaatctgaagtaaataattgagatggagaaaggaaaggaatgcgaatcgctgttttaggcgttactggacttgttggccagaaattcgtagctttgcttcataagtggtatcgtgattgggtcattgctgaagtcgtagcttcaaatagtaaatatgggcaatcgtatggagatgcctgtatttggcaagagccaatcggccctatgcctgagatggtacgtgatttgcctatacgtaagatcgaggaagtgcagtccgacatcgttgtttcttttttgccttctagtgctgagtccatggaggcgtattgcctctctcaaggaaaagttgtcttttctaatgcctcaacatatcgcatgcattcttcagttcctattatcatccctgaagtcaactcagatcattttcaacttttagaagagcaaccttatcctgggaaaataatcacaagtcccaattgttgtgtctctggaattactttggctctagcacccttaagaaagttctccttagatcacgtacacattgtcaccttacaatcagcaagtggtgcaggctatccaggagtcccgtcgctagatcttcttgccaatacagttcctcatatcgttggagaagaagaaaaaattcttagagagactgtgaagattttaggaagttctaagcaacctttaccttgtaagctctctgtgacagtccatcgagttcccgtagcctacggtcatacgctctctctgcatgttaccttttctaaagatgtagatcttgacgagattctgtactcttaccaagaaaaaaataaagaattccccaatacctaccaactctatgataacccttggtctcctcaggctcgaaagcatctttctcacgacgatatgcgcgtacacctaggacccattacctacggaggagattttcgcaccataaagatgaatgttttaatacataatttggtgcgaggtgctgcagggactttactcgcaagtatggagaattattttttcgactatcttaagagggaaatgtgtctaagatagtttataaatttggtggcactagcttagcaactgctgagaatatctgtttggtttgtgatatcatttgcaaagataagccttcttttgttgttgtaagcgcaatcgccggtgtgacggacctccttgtagacttctgctcgtcttctttaagagaacgagaggaggtcttaagaaaaatagagggaaaacatgaggagattgtaaaaaacctagcgattccttttcctgtctctacatggacgtctcgactccttccctatctacaacatctggagatctcagatctcgattttgctcgtattttgtctttaggagaagatatttcagcttccctagttcgtgctgtttgtagcacccgtggttgggatttaggatttctcgaggcacgtagtgtcatcttaacagacgatagctaccgacgtgcctctccaaacctagatcttatgaaagcacattggcatcagctcgaactaaatcagccttcgtatattatccaggggttcatcggatctaatggtttgggagaaacagttcttcttgggcgcggaggcagtgattattcagcaactttgatcgcagagcttgcaagagcaacagaagtgcgtatttataccgatgttaatgggatctataccatggatcctaaagtgatttccgatgcacagcgcattcctgagctcagtttcgaagagatgcagaatttagcaagttttggtgctaaagtcctttatcctcctatgctctttccttgtatgcgtgcgggaattcctatttttgtgacatcaacatttgaccctgaaaaaggaggaacatgggtctatgctgtcgataagtctgtgagttatgaaccaagaataaaagctttatccttaagtcaataccaaagcttctgttctgtagactatactgtcctaggatgtgggggattagaagagattttaggcattttagaatcccatgggatagatcctgaattgatgatagcacaaaacaacgtcgttggatttgtaatggatgatgatatcatttctcaagaagctcaagagcaccttgtagatgttttatcgctatctagtgtcacacgcttgcatcatagtgttgcattgattaccatgatcggagataatctttcttctccaaaagttgtctcaacaattacggagaaactcagaggttttcaaggacctgtattttgtttttgccaaagttcaatggcattaagctttgttgttgcctcagagttggcagagggtattatagaagaattacataatgattatgtaaaacaaaaagctatagtcgccacgtagggagaatcatgcatttacttacagcaactgttacaccttttttccctaatggcactatagattttgctagcttagaacgtcttttatcttttcaagatgcagttgggaatggagtggttcttttagggagcactggagaaggcctttcgctaacaaaaaaggaaaaacaagcactgatttgctttgcttgtgatctacagcttaaagttcctctttttgttgggacttcgggaacccttctagaggaagtcttagattggattcatttttgcaatgacttgcctatctcgggattcttaatgacaactcccatctatacgaagcctaaactatgcggtcaaatcttatggttcgaagcagtactcaatgctgcaaaacatcccgcgattctttataacattccatctcgtgcagccacgcccttatatttagatactgtaaaagccttggctcatcatccacaatttttgggaatcaaagattctggaggctctgtagaagagttccagagttataagagcatcgctcctcatatccaactttattgtggagacgatgttttttggagcgagatggcggcatgtggagcccatggtttaatctctgtcttatcgaatgcttggcctgaagaagcccgagagtatgtgctgaaccctcaagaacaagactatcgttctttatggatggagacgtgtcggtgggtatataccacaacaaatcctattggaattaaagcgatccttgcctacaaaaaagctattactcacgctcagctgcgcttgcccttgtctatagaagattttgatttggagaatgtatctcctgctgtagaaagtatgcttgcctggccgaagttacgtacctctgtgttctcctattcttaatgcagcaaaaccttatcttctgcatctatcttgttctaacttattactttacaaataaaatttttgcagaggttttttctagagaatagtgcttttgttctggatttttaacaagatgcgtcgcatttttttcttctttttacatcgcttatgattttttatgactccgaaatcgattcaacaattgcacttaataaagactattgatccagtaagaaaaatttctcctgtaacaacaaaaaaatcttcgttctttagacagtctcttcttagatttttagaactattttggatgtttctttactgtatacgctctattagattccattgtgttcatatcgccacctttatctgtcgaggtcttattctttttctgactaccttgttcttatctatgatatgcatcttgcatttcattactcttccttggatctgtaaggaagaccctcggattataagaaaaaataaataatcttgtttcatcaccaagaatcaggtcattttgtcttcatagtttctgattttttttccatttttgtcgccatattcaagattttcaaaatcgtgcttcagctatactgaggagtttattttgaataatttttcattcaaaaaatgaaatataattcaagagaaaaaataaaaagcgctttacggatttgctcttcatattgtatcactgtctttcgaaataatttcagtttaagttgttatgataaaattttctattcgttgtcttgttatgttttcaatggcccaaacagtattgggcgctgccgaagtttttgtttcttcagaggaaaaaaaactgaagtagaaactaaagaagtgaaaatcaaagatgagattcgtccttcattggaaggaaatgatcctgtaaaagttgcggagtcattccctaaaagaagagcagctcttgagtctttaagttctcaaagttccatcggcaatctttgtgcaattagtaatttcttagattctcaaatgttatctagaaatttctcaaaagagatctggggatctacaatcttcacacgatctaaatctacatgtgatgccgaaggatctgagcctttccgttatactgcatgtggatacctagctggtcttagatctaaactagcaggttcttatgaattaggtgtaactgcaggattgctacagggacgccttaaagatgtttcagatagccatagaactcgtgcgacatcttcaatattgtccgtgcatggtagtatggttacaagaccgttgagttgtacgaagtatatcgtaggaaaagcgcgtcctttacttttcttcttcagattaacatcggatgtaagaagagatttgaaaaaaaagttcagacttgaattttgcaaagattgatcacaatcatctctaccttacatgtttgggagatcttggtgtagcttgtcctatactttctacagattgtctacctaattatagcgagaaagcatctcatgaggttcttgtttatagtaaatttagatgcatttctggagagccatctcgacttgcaacttcaggaaatgacacatattattctatagtaagtttacctataggactccgttacgaagtgacttcaccatcaggacgtcatgatttcaatattgatatgcatgtagctccaaagataggtgcagtactctctcatggaacacgagaggctaaagagatcccaggatcttcaaaagactatgcattttttagcttgactgctagagaaagtttaatgatttctgaaaagcttgcgatgactttccaagttagcgaagttattcagaattgttattcacaatgtactaaagtaacgaaaactaatttaaaagaacagtataggcacttatcccacaatacagggtttgagttaagcgtcaagtctgcattctaaaaatagttcttgttctcttggacttgaaaaagccattcctatttgaaaaaatgggaatggctttttttataataggtcgaaccaaagaggaacttgtttcattaaaattacttaaaaagtgatatcgttttctaaatacaaagataaaaatactcaccaatatactcgcacaaccttgacaaaggaagttttcttgaagatctttttcggtttttataagaaaattcttctttagaaggaagatgaatctctttgaataaaatactatatattagtagcttagtgggtttaatttatgtgtttgatcgcgatggcaccacagattcataatgcaagtacttctatctccgcagctacccccccccccccaacactctgtagggtcgatttcttctccatctaaacttcgcgttttagcgattacttttttagtttttggtatgctcttactgatttcaggagctctctttctgacgttagggattccaggattgagtgcagcaatttcttttggattaggcatcggtctctccgcattaggaggagtgctgatgatttcgggactactatgtcttttagtaaaacgagagattccgacagtacgaccagaagaaattcctgaaggggtttcgctggctccttctgaggagccagctctacaggcagctcagaagactttagctcagctgcctaaggaattggatcagttagatacagatattcaggaagtgttcgcatgtttaagaaagctgaaagattctaagtatgaaagtcgaagttttttaaacgatgctaagaaggagcttcgagtttttgactttgtggttgaggataccctctcggagattttcgagttgcggcagattgtggctcaagagggatgggatttaaactttttgatcaatgggggacgaagcctcatgatgactgcagaatctgaatcgcttgatttgtttcatgtatcgaagcggctagggtatttaccttctggggatgttcgaggggaggggttaaagaaatctgcgaaggagatagtcgctcgtttgatgagcttgcattgcgagattcacaaggtggcggtagcgtttgataggaattcctatgcgatggcagaaaaggcgtttgcgaaagcgttgggagctttagaagagagtgtgtatcggagtctgacgcagagttatagagataaatttttggagagcgagagggcgaagatcccatggaatgggcatataacctggttaagagatgatgcgaagagtgggtgtgctgaaaagaagcttcgggatgccgaggaacgttggaagaaatttaggaaagcagtcttttgggtagaagaagacgggggctttgacatcaataatctccttggagactgggggacagtgcttgatccttatagacaagagagaatggacgagataacgttccatgagttgtatgaaaaaactacgtttttgaaaagactgcacagaaagtgtgcgttagcgaaaacaacctttgaaaagaagagatctaaaaagaatttgcaggcagtcgaggaggcgaatgcacgtaggttgaaatatgtaagggattggtatgatcaggagtttcagaaagcaggggagagattagagaaactgcatgctttgtatcctgaggtttcagtctctataagagagaacaaaatacaagagacgcgctctaatttagagaaagcctatgaggctatcgaagagaactatcgttgctgtgtccgagagcaagaggactactggaaagaagaagagaaaagggaagcggagtttagggagaggggaaacaagattctttctcctgaggagctggaaagttctttggagcaattcgaccatggtttgaaaaatttttctgagaaattaatggaattggaagggcatatcttaaaacttcagaaagaagccacagcagaggtggagaataaaatactttcagatgcagagagccgccttgagattgtatttgaagatgtcaaggagatgccctgtcgaattgaggagatagagaagacgctgcgtatggcggagctgcccctacttcctacgaagaaggcgtttgagaaggcctgctcacaatataatagctgcgcagagatgttggagaaggtgaagccttactgcaaggagagcctcgcctatgtgactagcaaagagcgtttagtgagcttggatgaagatttacgacgagcctacacagagtgtcagaagagattccagggggattcgggtttggagtcggaagtaagagcctgtcgagagcaactgcgagagcggatccaagagtttgaaactcaagggctggacttggtggaaaaagagttgctttgtgtgagtagtagattaagaaatacagagtgcgattgtgtatctggtgttaagaaagaagcacctcctggtaagaagttttatgcccagtattatgatgagatttatcgagttagagttcaatcccgatggatgacgatgtctgagagattgagagagggagttcaagcatgcaacaagatgttgaaggcaggcctaagcgaagaagataaggttcttaaagaagaagagtattggttgtatcgagaggagagaaagaataaagagaaacgtttggttggtactaagatagtagcaacgcagcagcgagttgcagcatttgaatccatagaagttcctgagattcctgaggccccagaggagaaaccgagtttgctggataaagcgcgttctttatttactcgcgaggaccatacctagcataactccaagagttgtgtttctttaaaaattctttgaataaaatactatatgttagtagcttagtgggtttaacttatgtgtttgagcatgatggcgccacagattcataatgcaagtacctctatcaccacagctaccccccccccccagaccactctgtaggggcttttttttgtctgtctaaatttcgtgttttagcaatcacttttttagttcttggtgtgcttttcttgatttcaggagctctctttctgacgttggggatttcaggattgagtgcagcaatttcttttggattaggcataggtctctctgcgttaggaggagtgcttgttgtctcaggacttctatgtcttttagcaaaacgagaggttccgacagtacgaccagaagaaattcctgaaggggtttctgtggctccttctgaagagccagctctacaggcaactcagaagactttagctcagctgcctaaggaattggatcagttagataggtatattcaggaagtggtctcatgtttaggaaagctaaaagatcttaggtgtgaagatcaaggtcttttaaaagatgctaaggagaaacttcaagtttttgactttgtctggaaagacatgatgaccgagtttgtagagctacaacagatcatggatcaagaggggtggtatctaaagtgcctgattcaggagatgcgggatataggaagcacactttttatgagtcaggttagtttatttaaattatgggaatggcttgggtatttaccttctggggatgttcgaggggagcggttaaagaaatctgctcgtgaggttgtggatcgctttatgagaaggatttgcgatacgcggaaggtggccatgacttttgataggaatgcctatggagtggcgaagacggcctttgaaaaggcttttggagctctggaaacgtgtgtatataagagtatgacagagagttatagagaggccttttgtgagtataagaagacgaagatccttagggatgaggagaagatattaaggatatgttatctcgagttgaggagatagagatgatgcttcgtgtcatagagcttccactacttcctataaagcaagcgttggagaaggcttttgtacaatataatagctacaaagcgaagttaaccaaggtagaaccttgctttagagagagccctgcctatataactagcgaagagcgactccagagtttggatcagactttagaacgtgcgtacaaagagtaccagaagagattccaggagccttcacgtttggaatcggaagtaagtggatgtagagagcatcttagagagcaggtaaaacaatttgaaactcaaggactagacttgatcaaagaagagcttatttttgttagtgatgtgttattccgaaaaatggtcagttgtctagtgtcgacagtgcatgttccctttatggagttttattatgagtattttgagttgcatagattgaggttgcgggcccaatggatggcgaatgccgagatttatagcaaagttagaaaagcattcccagagatgttgaaggagaccttagaaaaagctaaggctcccagagaagaagagtattggttactttgcgaggagagaaagagtaaggagaagcgtttgattctcaacaagatagaggcagctcagcagcgggtaaaagatttagaacctcctcctattaaagagacagggaaacagaaacggaagaaagaatattcgtttttcattcgattaaaatcgtgattcgaggcaaccctgcattctatagattttttctcagagttctagtgatctaagtacgaagaggaagaaagacttttgtattttttgcatcctagaattttttgttttgcatagtattcgttatagaagtgttttaattattactaactattttatttataaaatggttagctcttctgttcatcataagaattgtaaaatgtgtattaaaagacgagaattttatttaaaataaattatacacttttacttttttaattttgctatgcctgagcctctatatacgaataagctaatcacagagaaatctccatatttgcttctttatgctcatacccctgttaattggtatccttggggagctgaggcatttcatattgcagctatcgagaataagcccgtcttcttgtctataggatgcaagcattctcgatggtgtcaggtgatgttgcaggagagctacacgaatcctgaaattgctgctatgctcaatgaatacttcgtgaatgtaaaagtagataaggaagaacttccctatgtagccaagctgtatggtgatcttgctcagatgcttgccgtttccggagatcaccaagaaactgtctcctggcctttaaacgtctttcttactcccgatctcgttccttttttctctgtaaactatttggggaacgagggaaaactcggtcttccctcattcccacaaattattgataagcttcattttatgtgggaggatgctgaggaaagagaagctctcgtcgaacaggcaatgaaagttctggaaatcgcgtcgtttttagaggggtgtgtaagaaaagagatcttagacgagagctctctaaagcgaaccgtagccgcgttataccaagatatcgatccccattatggaggagtgaaagcatttcctaaacgattgccaggtttgctcttacaatttttcctccgatacagcctcgaatatcaggagagccgaggcttattttttgtagatcgctctttgagtatggtggctttgggaggagttcgagatcacattggcgggggagtttattcatacactatcgacgataagtggttgatccccgcttttgaaaaacggctgattgataatgccttaatggctttaaattatttagaagcttgggcatgtctgggcaaagaagaataccgtggtataggaaaacagatactttcctatatcttgagtgaattatactctccagaggtgggtgccttttatagctctgagcaagcagaaaattggggagcaggaggacaaaatttttatacatggtctgtcgaagaaatctccaatgctttgggagaagatgctgagattttctgtgattactacgggatttctagggagggcttcttcaatggcaggaatatactccatattcctgtacatagagaaatagaagagctgtcagaaaaatatcatcgttctatagaggctattgaagatatcgtagatagatctcgagatattttaaaggggattagagcccaacgttcccatcgttctaaagatgatctatctttaacttttaacaatggctggatgatttatacttttgcctacgcaggccgacttcttggagaggttgagtatattgagattgggaaaaagtgtggggaatttgtccgaaattccctctataaacaccatgaactttaccggagatggagagagggagaggcaaaatatcgagcgagtttagaagattatggtgctcttattttaggggtgctagctctttatgaatcaggatgtggatctttctggttaagctttgctgaagagctgatgcaagaagtcgtcctttccttccgttcagaagaaggaggtttttatagtgttgatggtcgggatagcaccttgctgatcaagcaatctcccctttctgatggagagacgatctcaggaaacgctctaatctgtcaatgcttgctctcactgcacctaatcacagaaaaaaaacactacctgacttatgctgaagacatcttgcagatagctcaagcatgtgctcatacccataagttctcttccttaggattgctgattgcatcacagaactatttttctagaaaacatgtaaaagttttaattgctttaggggatcaagaagatcgcagtcctgttttgaaatgtctctcaggtttattccttccttatctatctctaatttggatgactcaggagaaccaagaacatttagagactgtgcttccagaatatgagcactgtcttatccctaaaggggattgcacagctacgacaatttatgttttagaagtcgatcaatgcaaaagatttaaagacttagaattgtttcgtcgttatctaatctctctatagaacgctatactagttattgataaagtgttttttactaattaaaatttattctttttaggaaagaaaacaccttctctcagtggtcaaaattaccacaattccttatagtaagtccctgggcaggtcaaaatctatagggtaggaagtcatgaaattatatcagaccttgcgaggtattgttttagtaagtacgggatgcatattcttaggaatgcacggaggatatgccgctgaggttccagtgacttcatctgggtatgagaatcttttagaatctaaggaacaggatccttcaggtctagcgatccacgatcgcattttgtttaaggtagatgaagagaatgtagtgactgccttagatgtgatccataaattaaacttactattttataattcgtatcctcatcttatagattctttccctgcacgatcccagtactatactgcgatgtggcctgtggttcttgaatctgtgattgatgagtttttgatggtggcagatgccaaggcaaagagaatcgctacagatcccaccgcagtgaatcaagaaatcgaagagatgttcggaagagatctctctcctttgtatgcgcattttgaaatgagtcccaacgatatttttaatgtgatcgatcgcactttgacagcacaaagggtgatgggtatgatggtgcgctctaaggtaatgttgaaggtgactccagggaaaattcgagaatattaccgaaagctagaagaagaagcctctaggaaagtcatctggaagtatcgtgtgttgacgattaaagccaacacagaatccttggctagccagattgctgataaagtgcgtgctcgtctaaatgaagcgaaaacctgggataaagatcgtttaactgctcttgtgatctctcagggagggcaactcgtctgctccgaagagttttctcgagagaatagtgagctctcccaaagccataagcaagagctggacttgattggctatcctaaagagctctgtgggttgcctaaggcacataagtcaggatataaactctatatgttgttagacaaaacctcaggttctatagagcctttagatgttatggagtccaagatcaaacagcatctttttgctttagaagctgagagtgtagagaaacaatataaagacagattacgcaagcgctacggctatgatgcttctatgattgcgaaacttctttctgaagaagctccacctctattttccttattataggggattgagtgacaagaagttctcctgcacaactctcccggtttctttctgaaattcaaaataagccgaagaaaagcctctctcaaaatttcttagtggatcagaatattgtcaaaaaaattgtggcaacctctgaggtgattcctcaagattgggtgttggagatcggcccaggatttggagcccttacagaagaactcatagctgcaggagctcaggtcattgctattgaaaaagacccgatgtttgcgccatctttagaagagctccctatccgcttagaaattatcgatgcctgtaaatacccgttagatcagcttcaggaatataagactttgggaaaaggtcgagtagtagcaaatcttccctaccatattaccactccattgcttaccaagttgtttctggaagccccagatttctggaaaacagtgacggttatggtccaagatgaagtggcccggcgtattgtagcccagccagggggtagggattatgggtctctaacgatctttttgcagttttttgctgatatacactatgcttttaaagtttctgcttcatgcttctatccaaaaccgcaagtgcaatctgcagtcattcatatgaaagtcaaagaaacacttcctctatcagacgaggagattcctgtattttttactttaacaagaactgcatttcaacagcgtcgaaaagtactcgctaatactctaaaaggcctctatcctaaagagcaagtggaacaagctttgaaggaattaggattacttctaaatgtgcgtcctgaagtattgagtcttaatgattatcttgctctcttccataagatgcaagcgggttaaaggtactttcccttctaaggaaattacaatctctagggataattaaactctgacgtctccaacagtctgcttttttgatctgaagttgaaatgagtgagaatgcggttggtcatactactctcatcaaggcctatagattttgtgagggcttccttactcccatgggataggaatgtatcggggattgcaaaatttaagatatcgaccttaaaattgaacgtagctacaaaattattaaactcggacgctaatcctcctcgaatggagtgctcttctatggtaatcaccttagagtgactcatcagtaaaagactgaaaagatcgttatcaaaaggttttataaagatcgggtctacaacagttgcggagatgccataagcaagcaactgatgttttatagatagggccgtgaagcagagggttccaagagctatgatgagaacgtcctcaccttgtgagagggtctcagcattgcctggggatcttaggaaatttggatctccagtgagtgggtctccatgaggagctgggatattggggtagcggatagcagaaggagaggaccagtgtagagaagaatacagtagctgttggaataccacctggctacgtggctgacagataatcatctggggcatcgcacgtaggaaactcatatcatagatgccgtgatgactacgtccatcaccataggcaagtcctgcacgatctatagcaaaaatcacgggaagatcttgcatgcaaacatcgtggaaaacattatcgagagcacggtgtaaaaatgtagaatatatagaacagatcacaggattgccggcttttgcaatgcctgcactgaaagtcactgcatggccttcagcaatccctacatcaaagaagcgttctgggaacttctgtttgaaaccttccaaacgagatcctatagacattgcaggagtcaccacatggagacgtgaggaaacctctccaagttcacatagcgtttggccaaatatatcagggaaagaaggcttaggcttaatcgcaggaagatgttttgcggattctcgcttattgaagtttgctctgactccgtgatactttgcagggttattttgggcttggtctaggcccttccccttagttgtacagacgtggacaagaataggaaaagggaggttacgaacggactgaaggatggggatcagttttttaacattatgaccgtctatagggccgacatacgctaatccgaattgttcaaataaaggagtgggacagaagagatttttaacacattgtgaaagtctccgactgtgctttgctaagctatccccatagcgtggaattttagcgagccatttttccacttgcttagtgagtttattggttgcagggtggtgtagccatcgggaaaagattcgagacatggctcctacgtttttagagatcgacatattgttgtcattcaaaataacaacaaacttcgataaatctgttgaaatattgttcaacgcttctaaggtaagaccacaagagaatgcagcatctccaaggatgggaatgacgtgtgtgcgtgattctaaaggggttgtttgagccattcctagagctaaagacaatgccgtccctgcatgtccagagaaaaataaatcgtggtcactctccgtagggttggtaaaaccactgaggccgttgtcattgcgtatatggtcaaatccttcattatttcttcctgtcagtagtttatgaggataggtctgatgtcctacatcaaaaataaatttatcttttggggaagagaacacgtaatgtaaggctatagtaagctctacgattccaagatttgaagataagtggcctcctgtttgtgataatacagagatgatgcgataacggatttcttcagctaaaccaggaagctgagaaatagagagtttctttaaatctgcaggagacaatatcaggtctaaaagggggcaagaagacgaagtcatgaccttagtgatgtggatgtataggaaacgtttgtactatagggtctccagaaggacttttgaggagttctcctttggagttaacagaaagaagataacatagttgatcttttcttaatgctttatttaatccttcatagatcaaagaaaacatggcctcatatgtagctacaatatcactcaaagagtttaaggtttctaaagattgttgtaaggcgaataacttttttaatgaggggtctttgtgatggatttctaccataagactaccgaactacagcttgttcctcaaagagagaactttcatgacgcttttctgccaactcacggactctttgctctacttgtcgaatacgagattcacaaatacgcattaaggcatcagcttcttcatatagggctagagatgcatccaaagaagtcgtgggttgattcataaggtcaacaatttcttctagtcgttgcattgcattttcgaaggggacctcttccatgatttagccttttataagtttacaaatttcaatatttgtgacagttaaaatggcctcgccatcttgcaactgaatccttacacgagcattttcttgtaagctgtctacggaaatcatagcggaattttcattaaagtcaaagagcattgcatacccgcgttttaaaacatttttcggatttaaagagtgaagttgttcttttagcgcagagtagcgggcaacagaattttcgtaacgacgttctagaattgttgctaaagtttccttgacatttgcataggcgattttttggttttgtagatttagctcgcatcctctcgatagacgtctgcctaatagttccagtttctgcacatggctacggagctgttgctctaagacattgtgagcatgcttgagtcgtgtgtgtttatgaaaatattcttctttttggtagtggaggcgtcgtgaaattagggtgtctagctgttgacgccaaggggataatttctgtgatgcctgttggatttggcgaggataggtaaggcttttctttagttggtggcaacgtacttggagagaaagtgctttatgggatagggcttgtgaaagcatttttttcaaactttgcagtcggcaggtcatgcgggaaacaagatctccttggagccaccgcgagatgttgtcatagcgttgtttgctttcgtgaattttcccttggacacctttttgaatagcgatctcaatagagtcgagttgctgttgtgctgtagtatagaattctgcgcgatctaaaaagcgtctccagggaagcaattgctgtttttttgatgtgaggagttggcgagagtgtgagagtagatggcggaggtatccctcgaacacctgaacttgctcttcgctacttttacagacgatctctgcggctgcagaaggagtgggagcacgcacatcagaagcaaagtcacataaagtgtaatcagtttcatggccgacagcagagacaatagggattgtgcttgcatgaatggctttaactaagatttcttcgttaaaggcccagagatcttcaatacttcctcctccccgagcaataataagaacgtcagcgaggttctcagcgttcatcacttcaatagccttggagatttcatgagctgcagagttcccttggacagtgacgggataaactaaaattttatagttgcgagcacgccgggagagtacacgtaagatatcttggatcacagctcctgttgggctagtaatgacgccaatgcattgaggagcaaaggggaggggcttctttttttcagttgcgaaatacccttcagcagtcagacgtctttttgtttcttcaaatttttgtaggagatcgccctctccagcgtaaaccaaagcatgggctacaatttggtattgtcctctaggagcatagaccgcaagcttcccatgaataataactgcatccccatctttgggtttgcggtcatagtacttacttttaaaatgaaaaaaggcaccattaagaaacgcttggctatccttaatcccaaaatagagatgaccacttggttgtagggagacgttgctaagctcgcccttcactatgatctgacaaaaattggactcaagaagagtcttaatgcgttcagttagggatgcaacagcctgtggaggcgatgacataacaggaaagcctctctagagaattcagtgactttagagtaagtgattttctgatagaaaactattaaaaaatcattgattctgtcgggaaagtatgcggataaaattcagagagaataaggagaggaagatgacaaggcagagttatgttttgggcaattggaaaatgcacaaaacaatccaagaagctaaagagtatgttcaaacattagcttctttactacaaggagaacctctttcctgcactataggcatagcttctccatttacctctttgagagcgattcatgaggtgataaacactacgggagcttttctctggttgggagcacaaaatgtccatcccgagctttcgggtgcttttactggagaaatttccttacctatgcttaaggaggtaggagtggaatttgttttagtaggtcactccgagcgtcgtcatatttttggagagagtgatgcctttattgcttcaaaggtaaagtctgtagctcaggcgggactcgtgcctgttctttgtgttggagagagcttagaagttcgtgaagagggaaaggcgcatcaggtaatcaaaaaacagttgcttttgggattggaacagatggataatggttccgaatttttgatcgcctatgaaccagtatgggctatcggcacagggaaggtggcagaagcttcggatgtgcaagatattcatatgttttgtcgtgaggtagtggcagagaggttctcagaagctacagctgaagagatttcgattttgtacggaggatctgtgaaggtcgataatgctcagcgatttgggcaatgtagcgacgtcgatggtcttttagttggcggagcttctttagaagggcaaagtttttttgaagtcgctaaaaattttaatgtataatttgtgagagttatgagatttttttgtctattttttcttgggttcctaggatcttttcattgtgttgctgaagacaagggcgtggatttatttggagtctgggacgataaccaaattacagagtgtgacgatagttacatgacagagggtcgtgaagaggttgaaaaggtagtggacgcttagtccatcggcttttatttatattctccctaaggaagtcctgtattgaagatcgctttctcatagatagaagtaattttcagatagtcaataattggtttttttaagagaatgctaggcaggtgctcgtgtttgggcatttgattaagtctacatgaatctggagggagagattcttctggtattgagaagtagaacaaaaaacaaggatcagacgttctccgatgtcttcctaatcgatgtctttaaataaggagattggcatgacagtgttgttttacgcatttttattcattttcctttttctatgtgtaattctttgtggcttaatcctggttcaagagagtaagagcatggggttaggttcttcgttcggcgtggattctggagattctgtctttggtgtctctactccagatattttgaaaaaagtgacttcatggtgtgctgttgctttctgcataggttgtttactactttcattttccacgaatctcttggggaaaaagttagatgctaaagaatttctattgcctgctgctgaggagagcgacactcaagcttcttctgagagcgttgaagcagatgaatcctagcctatttgcggaattaggtgttgtctagattgaattgcaataaagctagcaagtttttattttcatacgagatatgagtgtacggtcggataagagtagaaatctttcttttgttcctatggttaagaagtcctttggcttccttaaagagtatgactcttatcaacccaagaaatgttttagatccaagtgcttgtcgtacgagatttcttcacagagctctgccaagcccatgttcagactatgattagacgtttagaatattacggcagtcctattttaaggaaaaagtcttccccaattgcagagatcacagatgagattcgtaatctcgtgagtgatatgtgtgatactatggaagcacatcgtggtgtcggtttagccgctcctcaggtagggaaaaacgtcagtttatttgtcatgtgtgtagatagagagactgaggatggagagttgattttctctgagtctccgagggtatttatcaatcctgttctatcagatccttctgaaaccccgatcataggtaaagaaggatgtctttctattcctggattgcgaggagaagtattccgccctcagaaaatcacagtgaccgctatggatctcaatggtaaaatatttactgagcacttggaaggattcactgcacgtatcattatgcacgagactgaccatctgaatggagttctctatattgatcttatggaagaacccaaagatcctaaaaaatttaaagcctctttagagaagatcaaacgtcgctacaatacacacttgagtaaagaagaactagtttcttaattgctcttcagtctgatgtaggtgatattttcttgtctcttgcgtcacatttgttgtcagctttgcttatttccccgaacaaatttcgtcaaaggttttaaaatgtgtcttgctgatttttgctaagagctctttccctcgttgcttagcgatctctcttcctgctgctttgacattgaatccagcacctttaggaagctgtacttgatattgttcttccaacttctgtatcgactgtacaaatgcatctctagccaatatagaagctgctgctacgactacatcttgttctgcacgtggcttttgtattaaagtaatatcggtttcttttttttgaagtgctttgagtagggtgtattctgaagctgcaaactgatctgaaatagcaaagacatctcctgcaggtttgggtgctaagttgttgataacagtagcgtgggcccaagcaagaagtgtatttaaattctggaatttcccatatagctcgttatatttttctgggtatagaatgatgacatcgcagacacatagtgagcgtatgatacgtgctaaagaagcgattttcgtgtctttgagatttttagagtcttggactttattctcatagagtttttttaagatctctgcattcgatgcatagactgccgcaatacataaagggccaaaaaaatcacctttccctgattcatcgactcccaaccttggacgaaggtcttgctctacccttgcatgggtgaaggtatgaaggatttctggttctaagaaaaattctatgaattcctcacttcctttaccttggattacgagtttcccggaggggtatagagtgcaggtaacagtgttagagcgagcttgaaatacggtattctgtggctgagaaaagataaaatttttttcttttagctgatctcttaaattgttttgagcagaagttgttaaagtaacaacaaatggtggcggcatgcaggacatctacctataaattatagaaaaaatttagaacgattgaattcctagtcctaggaatccaggatgcaaagtgctcatactttttatttttgcctactatatcgtatagttatgacaacttccaagtacaaattaaacaacaattttgtatatttctgcaaataactgcggggagccaaagatacaagagtgtaagatgtctagtattttacattcttaaggttttgagaaacactatataggtaatcatgcaagaacacatacataaagaattgctacatctaggtgaaatctttcgctcatcacgagagtctcaatccctatcgttaaaggatgtagaggctgcaacctcgatacgatatagttgtttagaagctattgaacaggggtgtttaggaaaattgatttctccagtttatgctcagggatttattaagaaatacgctacgtatcttgggttggatggagatagtatcttacaagaacatccttatgtcatgaaaatttttaaagagttttcagatcataatatggagatgcttttagaccttgaatcgatgggaggaaggaattctccggaaagagcaattcattcttggtcgaatctttggtgggcagggctgatcattataggtggcatcatggtgtggtggctcggatcgttgttttctattttttaacttaaggtctgttggtctctatttagaccaacagataggatggagtacttcttaccctaatttgaatagttgtgagactttctgagccccttgcaaaagttgtctttgattttcaggagaccagggatcttcatccctaccctcatcatcctcaggacctaagggctctcctaaaccatcacttcctgttgtactatcacagccatcggttcggtctcttctctgttgggagcttcctccaacaccgaaggcactggcatggaatgccaaatcctccgcctgtcacaataccatctctttctatttcgtcgtcatcccacgggtcaggaggtggtggagcttgtctaggagcttcgccttgggtttgtctccaaatgttctctccagctgtggtggtgactaatacctttctaagaattctttgccaaggaccttggactctagggtcaagaacagtttgctctggatgtagaggatctaaaggaagatatccttttgaaagaaggcatagaaggacaaggacttcaaatacctgagattctaaactcaaaccaataccaggacctaagaaagtcgcaagatcactggcaacaagtctttttagtgatttttttattaagtccacaatttgtttagcagcttgtcctaaaggacccttgtaaccggattctaagctcaaaacctctaacctggataatttttgtaataaagtcctaaaattgagtttgcatgtaacacggcattcttgagcggggtgcttcttttgttgaggagctggcgcgcctcctacagcaccttgtagctgttcttcgtctgttggaggtgggggacagggttgctgttctggttgtagaatccaacaagtaggaggattgtcagatgaagttacaaaggaaagagccccctctgaaacagcttgaagtatgagactccatggtggtgtctgttgcatgtcttcgcctaagccgttgttttgtaaaagcttgactagagattcacccatgcatcttggttgagctgcttttagtagttcccgatgtagcttgcaaccattttcaacctcctgtttatccccgtcacccaacggttcaccttgctcaatcttctgtgtacagtgcggtagctgttggaaagacataccaacacaaataggtccgtattgctgtataagttgttgtagaaattgtgctgagggattatcaggatcatccacggtctctaagcagcatgcgcaacaccctccccatatccattgtaagaaaccaggacaatgctctctgcaccagggagtcccggttctataacaataatgtcctagacgttgcattctagcactatctaagagattattaagtaacgagcctgcttgttctaccatacctagcacattgtctgatccgagcgagatacccatttcacgacctccagtcccaggctgttgtgtaattacacgtccaccttgagagccagattggcctccttcttgcagtggaatatcttctcctccgggatttggtgggggcgtttcgcgataataacaattacaatttccacatggaaatgtcataaggcttctcctttagtgaggttgagttgtatggatttttataattacgagttcttctagaaaggaattatagaatgttcagatagagtattttaaagcgggttatttcttattggatgattaagaaaaataggaaatcttgattatgtttttttgtcgagattacttttagagaaagagtttaaagtgatcgcgggttattagtcaatttattttttaatttaacatagatcctctcttaagtttccttgttgtgatgggataaatatttgggaagaaatgccgcaaaattttttctaagttctcaaacttttcaagaaaacatagattcttggatagaacaaaagcttcgcggcaaaaaataggaatcttattctttgtttatttttatccctaaaaatagagtttgtaaatgacccgagcattcaaggatacgctgttgatacgccaaattcccatcctcatcatcatcttcattttcatcttcttcttcgagacttgacatgagagggacagattctgcaggggtaggacaatcaagactttcctgtcttactaatgagggtttcttttttaaaaacgatgctgaagttttccctgttctatagctgtattgtagtcgatagaagatggtcataatcggatcatctatcatgtgtatatctacgacagatgtctcatcggtatttgcagggcaatagccaatcgctaacatcaataaaacgacgatatcacgaaaatttgggcacgtataacatatttctccacctgtgtgctttagaatagaagatgtgctttgtgatgcagataagagaaagctattcagcattttcacaatcaggagaccaaaaggacctaaagctgaaaaatctcctgtttttagattggtgacttggatttttcctaattgtctggccatgccattgtcattgtatttttttgctacgtactggggctctgcaccgactgaagatgggcgtcgcgcatctcttgatccacaggataggcgtgacgtcgttaaggggctcgtatttaagatatagcacgcaggaatgcgtgtagaattagaagcagaagatgttcctgaggcttcctctgattctatagttttttcccaagaccttgtagcaataaagcttagcacggcttggactagtgaatcgtctagaccgcgttctctaatgctgttgactccttcaaggaaaaagttttgagaaaggctctgcatcgttccatagagttgggttttagcttccgagcaatgctgtctaaattcatttttctgttcttcagacaaaatagtgtttttttctacaagttccattaagttgaggcccatagttttagcagctaaagcaacggcaataggaccatgggtctgttcgcattcatggacaagtccagcaacctgattatcctctctgtctaagcaacacgctttatacgttccacaaatgagtcttccaaaagatccgcaacgctgaccacatccagttgcgtaactgtcataacaatactctgtacatccttgcgttcgtctatgtgatagaatggagtctaccaattctcctgcttcttggatcatgtgtattgtactttcatcaccttgagcagtattaaattggacacgtttctctacttttgtaattttagtaggttgcgtagttataggagcagctcctccactcgaaccagcttcttcgcttatatctgaagccgattgccgcgttgtttcttctgttgttgttacttcaacccattcgcagttgaaatttccacacattctgaaccaagaattatttgggcaaaccatagtcgtacctttttaatatttagatttatttgggttttagagagttgaaaagaactctctaagaacaggaaaagagtcggtatgctctgcttgcgactgtgctgtttggaatgggaaacgaagggatcccagtgtctatagcacagtagagtgaggctaaacgtcaaaattgatttgaagaaatttgaattgctgacaagagggggagaggaattaaaaacgtcggacggaagaagatgtttagagcatgtataaagaaaattttaaattagatgcattatttcatgggtcttaccttatttagacttaagatggtaaggaagtctataaaatcattttttttaaaatctacggaatttaaaaaattacttgataatgatgtggagtcgtagaagtgcaaactcactagaaatttcctgaatttgagaaggagtttaaaataggtattcttgaaaagatcaatgcacgtgtagtggaaagaaaggcgtaacctacactggaaggagtttcttttagaagaaggtttcttttttcgttgttaatgacaaaaactctctaagaacatcgtgtcaaccgtttttattgttgtgtttatttaaaaaaaagattatatccttcatgcaaattggtgctgttggaaacaaatgttgaaaatccagaaaaaaagaatgtgtgtcagcgtagtcatcacggtaggcgccatagtggggtttttcaattctgcagacgcagcaccaaagaaaaagaagatccctatacagattctctactcctttactaaagtctcttcctatttaaaaaacgaagacgcaagtactatattttgcgtcgatgtggatcgtggacttctccagcatcggtatttaggtagtccaggatggcaggaaaccagacgtcggcagttatttaaatccttagaaaatcaatcatacggcaacgaacgtttaggagaagaaactcttgctattgatattttcaggaacaaagagtgcttggagagcgagatcccagagcagatggaagctatccttgcaaattcctcggccttggtcttaggcatctcttcttttgggatcacaggaattcctgcgactttgcatagtttgcttcgacagaatctatctttccaaaaacgctctatagcatcggagagcttccttttaaagatcgatagtgccccctcagatgcctctgttttttataaaggcgtgcttttccgcggagagactgcgatcgtggatgcgttaagccaattatttgcccagctcgatctttctcctaaaaaaattatctttctaggagaagaccctgaggtcgttcaagctgttgggtctgcttgtataggttggggcatgaactttttaggcctggtatactatcctgctcaagaaagccttttttcttatgttcatccttactctacagcaacggagctccaagaagcacagggtttacaagtaatttcagatgaagtcgcacagcttactttaaacgctcttccgaaaatgaattaacatgatgttagaacaacaagccctacgtattctctttccccctgagggtgcttagggccctttttatctagcatgagcggagatttaggttttagtgagatttttggtaaatatgaaaatattttcttaaaaagatcatgaaacagtcatacttttgcattgaaggatctttatgagacgttatcttttcatggttctagctttatgcctatatagagcagcccctctcgaagcagtggtcattaaaattactgatgcgcaggcagttcttaagtttgctagagagaaaactttagtatgtttcaatattgaagatactgtggtatttcctaaacagatggtcggccagtctgcatggctctacaatagagagctcgatcttaagactacactctccgaagaacaagccagagagcaggcgtttctggagtggatggggatttcttttcttgtcgattatgaattggtgagcgcgaacttaaggaatgtactcacaggcttatctttgaaacgatcttgggtactcgggatttctcaaagacctgtgcatttgataaaaaatactcttcgcattctgcgttctttcaacatagacttcacctcgtgtccagctatttgtgaagatggttggctctctcatcctacaaaggacacaacattcgatcaggccatggctatagaaaaaaacattttgtttgttggctctctcaaaaacggtcagcccatggacgcagcccttgaagttcttctctctgggatctcttctcctcctagccaaatcatctatgtggatcaggatgcagaacgtttgcgttctatcggtgctttttgtaaaaaagcaaacatttattttatagggatgctctacaccccagccaagcagcgtgtagaaagttacaatcctaaacttactgcgatccaatggtcgcagattcgtaagaatctttccgatgaatattatgaatccctcttgagctatgtaaagagcaaagggtagtgtcagcaaatcgatgtgggaatggtatcctgtggatggcatagacacgcaaggcgttttttatgccgtttttagatccttgtaggtgcagaaaaactaaaaagatcggaagagaagggattcgaacccctggttcctgtaagagaacttctgatttcgaatcagacgcattcgaccactctgccactcttccgtaatgcttcaatagtttagagaatctacactcagattgtctacatgtattgcacaatgtttttcataaatttatgaaatcataatgaagattagagaagatggccgagtagtgaagacgaattcttagagaaaaattagagtgttttcttgcgtatctaggcagaaaactaccctcaagaagaggcttgagggtgaagcat

SEQ ID NO: 2 - protein, 109 aa, Chlamydia pneumoniae
  CPn0001
KRLKDEIKYTSLRRKAMLGKIIRGLSSLIVILCALNVGLIGITHNKLNIIAKLCGGVSTPATQITYIIIGIAGVICLLSFCPFCSKKSRHSHGDSCSSGGCHSHHSDKN

SEQ ID NO: 3 - protein, 102 aa, Chlamydia pneumoniae
  CPn0002
HMEQFHLDREEILLLAKASALQLSEELIQEYQTSLSAVITSMKEALAIEIDDADSCESLFMHVVNVEDLREDSVTSDFNREEFLRNVPESLGGLVKVPAVIK

SEQ ID NO: 4 - protein, 494 aa, Chlamydia pneumoniae
  CPn0003
KIMYRYSALELAKAVTLGELTATGVTQHFFHRIEEAEGQVGAFISLCKEQALEQAELIDKKRSRGEPLGKLAGVPVGIKDNIHVTGLKTTCASRVLENYQPPFDATVVERIKKEDGIILGKLNMDEFAMGSTTLYSAFHPTHNPWDLSRVPGGSSGGSAAAVSARFCPVALGSDTGGSIRQPAAFCGVVGFKPSYGAVSRYGLVAFASSLDQIGPLANTVEDVALMMDVFSGRDPKDATSREFFRDSFMSKLSTEVPKVIGVPRTFLEGLRDDIRENFFSSLAIFEGEGTHLVDVELDILSHAVSIYYILASAEAATNLARFDGVRYGYRSPQAHTISQLYDLSRGEGFGKEVMRRILLGNYVLSAERQNVYYKKATAVRAKIVKAFRTAFEKCEILAMPVCSSPAFEIGEILDPVTLYLQDIYTVAMNLAYLPAIAVPSGFSKEGLPLGLQIIGQQGQDQQVCQVGYSFQEHAQIKQLFSKRYAKSVVLGGQS

SEQ ID NO: 5 - protein, 500 aa, Chlamydia pneumoniae
  CPn0004
EICQKCCSRRSIMSAVYADWESVIGLEVHVELNTASKLFSSALNRFGDEPNTNISTVCTGLPGSLPVLNQSAVEKAVLFGCAVEGEISLLSRFDRKSYFYPDSPRNFQITQFEHPIIRGGRIKAIVQGEERYFELAQTHIEDDAGMLKHFGEFAGVDYNRAGVPLIEIVSKPCMFCPEDAVAYATSLVSLLDYIGISDCNMEEGSIRFDVNVSVRPKGSPELRNKVEIKNMNSFAFMAQALEAEKQRQIDEYLNQPNKDPKLVIPAATYRWDPEKKKTVLMRLKESAEDYKYFPEPDLPTLQLTESYIERIRKTLPELPYDKYHRYIQEYGLSEDIASILISDKNIATFFEVACKDCKNFRSLSNWVTVEFGGRCKTLGVKLPSSGIFPEGVAQLVNAIDQGVITGKIAKEIADLMMESPGKNPEEILKEKPELLPMSDEGELQKIIAEVVLANPESIVDYKNGKTKALGFLVGQIMKRTAGKAPPKRVNELLLLELDKG

SEQ ID NO: 6 - protein, 932 aa, Chlamydia pneumoniae
  CPn0005
SDIHFDLGTKMRFSLCGFPLVFSFTLLSVFDTSLSATTISLTPEDSFHGDSQNAERSYNVQAGDVYSLTGDVSISNVDNSALNKACFNVTSGSVTFAGNHHGLYFNNISSGTTKEGAVLCCQDPQATARFSGFSTLSFIQSPGDIKEQGCLYSKNALMLLNNYVVRFEQNQSKTKGGAISGANVTIVGNYDSVSFYQNAATFGGAIHSSGPLQIAVNQAEIRFAQNTAKNGSGGALYSDGDIDIDQNAYVLFRENEALTTAIGKGGAVCCLPTSGSSTPVPIVTFSDNKQLVFERNHSIMGGGAIYARKLSISSGGPTLFINNISYANSQNLGGAIAIDTGGEISLSAEKGTITFQGNRTSLPFLNGIHLLQNAKFLKLQARNGYSIEFYDPITSEADGSTQLNINGDPKNKEYTGTILFSGEKSLANDPRDFKSTIPQNVNLSAGYLVIKEGAEVTVSKFTQSPGSHLVLDLGTKLIASKEDIAITGLAIDIDSLSSSSTAAVIKANTANKQISVTDSIELISPTGNAYEDLRMRNSQTFPLLSLEPGAGGSVTVTAGDFLPVSPHYGFQGNWKLAWTGTGNKVGEFFWDKINYKPRPEKEGNLVPNILWGNAVDVRSLMQVQETHASSLQTDRGLWIDGIGNFFHVSASEDNIRYRHNSGGYVLSVNNEITPKHYTSMAFSQLFSRDKDYAVSNNEYRMYLGSYLYQYTTSLGNIFRYASRNPNVNVGILSRRFLQNPLMIFHFLCAYGHATNDMKTDYANFPMVKNSWRNNCWAIECGGSMPLLVFENGRLFQGAIPFMKLQLVYAYQGDFKETTADGRRFSNGSLTSISVPLGIRFEKLALSQDVLYDFSFSYIPDIFRKDPSCEAALVISGDSWLVPAAHVSRHAFVGSGTGRYHFNDYTELLCRGSIECRPHARNYNINCGSKFRF

SEQ ID NO: 7 - protein, 53 aa, Chlamydia pneumoniae
  CPn0006
KQLQEPLRSALLERLSEWLVLLGVPSPETTRSTPEKDANQLPKDSRNRTLESL

SEQ ID NO: 8 - protein, 1003 aa, Chlamydia pneumoniae
  CPn0007
KSFRYNLSLIFSFLVVIPLTDSTTSSLSTSLLDEGNPQSMRKLRILAIVLIALSIILIAGGVVLLTVAIPGLSSVISSPAGMGACALGCVMLALGIDVLLKKREVPIVLASVTTTPGTGSPRSGISISGADSTIRSLPTYLLDEGHPQSMRKLRILAIVLIVFSIILIASGVVLLTVAIPGLSSVISSPAGMGACALGCVMLALGIDVLLKKREVPIVLASVTTTPGTGSPRSGISISGADSTIRSLPTYPLDEGHPQSMRKLRILAIVLIVFSIILIASGVVLLTVAIPGLSSIISSPAEMGACALGCVMLALGIDVLLKKREVPIVVPAPIPEEVVIDDIDEESIRLQQEAEAALARLPEEMSAFEGYIKVVESHLENMKSLPYDGHGLEEKTKHQIRVVRSSLKAMVPEFLDIRRIFEEEEFFFLSARKRLIDLATTLVERKILTEQLERNNLRKAFSYLYQDSIFKKIIDNFEKLAWKFMILSKSICRFTIIFENHEHGVAKSLLHKNAVLLEKVIYRSLQKSYRDIGMSSAKMKILHGNPFFSLEDNKKTIMKEHAEMLESLSSYRKVFLALSDENVVDTPSDPKKWDLSGIPCRDALSEISRDEQWQKKAHLKHQESLYTQARDRLTDQSSKENQKELEKAEQEYISSWERVKKFEIERVQERIRAIQKLYPNILEREEETTGQETVTPTVQGTTASSDLTDILGRIEVSSREDNQNQESCVKVLRSHEVEMSWEVKQEYGPKKKEFQDQMGSLERFFTEHIEELEVLQKDYSKHLSYFKKVNNKKEVQYAKFRLKVLESDLEGILAQTESAESLLTQEELPILATRGALEKAVFKGSLCCALASKAKPYFEEDPRFQDSDTQLRALTLRLQEAKASLEEEIKRFSNLENDIAEERRLLKESKQTFERAGLGVLREIAVESTYDLRSLTNTWEGTPESEKVYFSMYLNYYNEEKRRAKTRLVEMTQRYRDFKMALEAMQFNEEALLQEELSIQAPSE

SEQ ID NO: 9 - protein, 302 aa, Chlamydia pneumoniae
  CPn0008
CKYSYLLNYPPPPRRSLGVSCSKLRSLSITLLVLGVLLLTLGIPGLTAGISFGAGLGFSALGGVLVISGLLFLLVRREVPTVRSEEIPRGVSVTPSEEPALEKAQKEPETKKILDRLPKELDQLDTYIQEVFACLERLKDPKYEDRGLLTEAKEKLRVFDVVEKDMMSEFLDIQRVLNEEAYYVEHCQDPLENIAYEIFSSQELRDYYCAGVCGYLPSGDARADRLKRSVKEVMDRFMRVTWKSWEASVMLDHSYGVARELFKKAVGVLEESVYKILFKSYRDAFYECEKAKIQRDGRFKWL

SEQ ID NO: 10 - protein, 477 aa, Chlamydia pneumoniae
  CPn0009
DTSAHAEQRFRDINGCWEDLKQTIFWVGEHDCTDIETVRKSCMWLDRYADKFILREKEEKMERHELFHATMVRKASGHAYAKAKAAFEKERSNENQRKVKDVEKWLSKGLAEFRNQESRRARERLRELQTLYPEVSVEERVLERQRTKKVNLENLYADIEKKYHHCVREQEHYWKEVENKEAEYRENGEKVLSAEEVSECLQRLEDCLETWSKKLTKAEESVFEMKFDATEKLGNKVLSDVTNRLEILCEDAEEMIFRIEEIEMTLRMVELPLLFMKNTFEKASLQYNSCKEMLAKVEPQCKESPTYRSSQERLERLNQDLQTAYTNCQERLQGFSDLESKVRTCRDHLREQMKHFEVQGLNFINEELLWVGAELFTQARLDLVATVPYMEFYLQYHNIKREKVRSQWMAKTERYREIRQAFQGVMKEDLLAEDTILKEEDYWLLRDDWLLRDERKNRQRRLICNKIAAAQQRVKGF

SEQ ID NO: 11 - protein, 334 aa, Chlamydia pneumoniae
  CPn0010
CKYFYLRSYPPPPQHSVGSISSPSKLRVLAITFLVFGMLLLISGALFLTLGIPGLSAAISFGLGIGLSALGGVLMISGLLCLLVKREIPTVRPEEIPEGVSLAPSEEPALQAAQKTLAQLPKELDQLDTDIQEVFACLRKLKDSKYESRSFLNDAKKELRVFDFVVEDTLSEIFELRQIVAQEGWDLNFLINGGRSLMMTAESESLDLFHVSKRLGYLPSGDVRGEGLKKSAKEIVARLMSLHCEIHKVAVAFDRNSYAMAEKAFAKALGALEESVYRSLTQSYRDKFLESERAKIPWNGHITWLRDDAKSGCAEKKLGMPRNVGRNLGKQSFG

SEQ ID NO: 12 - protein, 493 aa, Chlamydia pneumoniae
  CPn0010.1
KEARDAEERWKKFRKAVEWVEEDGGFDINNLLGDWGTVLDPYRQERMDEITFHELYEKTTFLKRLHRKCALAKTTFEKKRSKKNLQAVEEANARRLKYVRDWYDQEFQKAGERLEKLHALYPEVSVSIRENKIQETRSNLEKAYEAIEENYRCCVREQEDYWKEEEKREAEFRERGNKILSPEELESSLEQFDHGLKNFSEKLMELEGHILKLQKEATAEVENKILSDAESRLEIVFEDVKEMPCRIEEIEKTLRMAELPLLPTKKAFEKACSQYNSCAEMLEKVKPYCKESLAYVTSKERLVSLDEDLRRAYTECQKRFQGDSGLESEVRACREQLRERIQEFETQGLDLVEKELLCVSSRLRNTECDCVSGVKKEAPPGKKFYAQYYDEIYRVRVQSRWMTMSERLREGVQACNKMLKAGLSEEDKVLKEEEYWLYREERKNKEKRLVGTKIVATQQRIQEFQPSDIVESSNEKVSLMDKARFLFNREDHS

SEQ ID NO: 13 - protein, 246 aa, Chlamydia pneumoniae
  CPn0011
FWYSIMTAAPAILHVSPTPPEETKFVIPKDSKSRALGITLLVVGILLVVCGAIVLSGVISGLSALIVCGLGISTISLGVVLFVLGLILLLRKRELTLEQIEAKQIAETFADELKELEMYIQSTEKSLEKIEGSRYSDQGFLNRATQKILDLESSLSSITSEFRDLRQLFDEEKIELLSGERLLEFIAANLFKQGRDVYLNLGNLADIRAYMGPNNYKVAMVIEKAKAVVHEFIVLTTMARELEFFF

SEQ ID NO: 14 - protein, 539 aa, Chlamydia pneumoniae
  CPn0012
GIRVFFLKNKYGLLKGMYQENLRLLERLLYNSVQKSYADRLFSYEKTKMVHDTPLIPWEEDKEKCAEAEKAFLEQQKILLDYGKSIFWLNENDEINLNDPWSWGLNTVRTRKVFQEVDDSERWNHKVLIQKLEDDYEKLLEESSKESTEANKKLLSDLVDRLEDAKTKFFLKKQEEVETRVKDLRARYGGTVDPKQDTEAKKKVELEASLETFLDSIESELVQCLEDQDIYWKEQDVKDLARTQELEEQDIEAKREEAAEDLRSLNERLKKSKTMLDRAKWHIENAEDSITWWTSQIEMKDMKARLKILKEDITSVLPEIDEIETCLSLEELPLLTTRELLTKSYLKFKICSETLLKMTSVFENNIYVQEYEVQLQNLGFKLQGISQRFGKKQDDFANLEEQVALQKKRLRELTQNFEIQGFNFMKEDFKAAAKDLYIRSTAEQKMNFDVPCMELFRRYHEEVNKPLLELMYNCADSYRDAKKKLCSLRLDEKELLQKEIKKEEFYQKKQQRHADRSRHTTYQKLRIAEELALELKKKI

SEQ ID NO: 15 - protein, 866 aa, Chlamydia pneumoniae
  CPn0013
LRDRLAFFIYLLYWKESPLREKKVVMKIPLRFLLISLVPTLSMSNLLGAATTEELSASNSFDGTTSTTSFSSKTSSATDGTNYVFKDSVVIENVPKTGETQSTSCFKNDAAAGDLNFLGGGFSFTFSNIDATTASGAAIGSEAANKTVTLSGFSALSFLKSPASTVTNGLGAINVKGNLSLLDNDKVLIQDNFSTGDGGAINCAGSLKIANNKSLSFIGNSSSTRGGAIHTKNLTLSSGGETLFQGNTAPTAAGKGGAIAIADSGTLSISGDSGDIIFEGNTIGATGTVSHSAIDLGTSAKITALRAAQGHTIYFYDPITVTGSTSVADALNINSPDTGDNKEYTGTIVFSGEKLTEAEAKDEKNRTSKLLQNVAFKNGTVVLKGDVVLSANGFSQDANSKLIMDLGTSLVANTESIELTNLEINIDSLRNGKKIKLSAATAQKDIRIDRPVVLAISDESFYQNGFLNEDHSYDGILELDAGKDIVISADSRSIDAVQSPYGYQGKWTINWSTDDKKATVSWAKQSFNPTAEQEAPLVPNLLWGSFIDVRSFQNFIELGTEGAPYEKRFWVAGISNVLHRSGRENQRKFRHVSGGAVVGASTRMPGGDTLSLGFAQLFARDKDYFMNTNFAKTYAGSLRLQHDASLYSVVSILLGEGGLREILLPYVSKTLPCSFYGQLSYGHTDHRMKTESLPPPPPTLSTDHTSWGGYVWAGELGTRVAVENTSGRGFFQEYTPFVKVQAVYARQDSFVELGAISRDFSDSHLYNLAIPLGIKLEKRFAEQYYHVVAMYSPDVCRSNPKCTTTLLSNQGSWKTKGSNLARQAGIVQASGFRSLGAAAELFGNFGFEWRGSSRSYNVDAGSKIKF

SEQ ID NO: 16 - protein, 186 aa, Chlamydia pneumoniae
  CPn0014
IQNQSIYFTMKSSFPKFVFSTFAIFPLSMIATETVLDSSASFDGNKNGNFSVRESQEDAGTTYLFKGNVTLENIPGTGTAITKSCFNNTKGDLTFTGNGNSLLFQTVDAGTVAGAAVNSSVVDKSTTFIGFSSLSFIASPGSSITTGKGAVSCSTGSLSLTKMSVCSSAKTFQRIMAVLSPQKLFH

SEQ ID NO: 17 - protein, 780 aa, Chlamydia pneumoniae
  CPn0015
LEFDKNVSLLFSKNFSTDNGGAITAKTLSLTGTTMSALFSENTSSKKGGAIQTSDALTITGNQGEVSFSDNTSSDSGAAIFTEASVTISNNAKVSFIDNKVTGASSSTTGDMSGGAICAYKTSTDTKVTLTGNQMLLFSNNTSTTAGGAIYVKKLELASGGLTLFSRNSVNGGTAPKGGAIAIEDSGELSLSADSGDIVFLGNTVTSTTPGTNRSSIDLGTSAKMTALRSAAGRAIYFYDPITTGSSTTVTDVLKVNETPADSALQYTGNIIFTGEKLSETEAADSKNLTSKLLQPVTLSGGTLSLKHGVTLQTQAFTQQADSRLEMDVGTTLEPADTSTINNLVINISSIDGAKKAKIETKATSKNLTLSGTITLLDPTGTFYENHSLRNPQSYDILELKASGTVTSTAVTPDPIMGEKFHYGYQGTWGPIVWGTGASTTATFNWTKTGYIPNPERIGSLVPNSLWNAFIDISSLHYLMETANEGLQGDRAFWCAGLSNFFHKDSTKTRRGFRHLSGGYVIGGNLHTCSDKILSAAFCQLFGRDRDYFVAKNQGTVYGGTLYYQHNETYISLPCKLRPCSLSYVPTEIPVLFSGNLSYTHTDNDLKTKYTTYPTVKGSWGNDSFALEFGGRAPICLDESALFEQYMPFMKLQFVYAHQEGFKEQGTEAREFGSSRLVNLALPIGIRFDKESDCQDATYNLTLGYTVDLVRSNPDCTTTLRISGDSWKTFGTNLARQALVLRAGNHFCFNSNFEAFSQFSFELRGSSRNYNVDLGAKYQF

SEQ ID NO: 18 - protein, 602 aa, Chlamydia pneumoniae
  CPn0016
RSDFALKRGCHMRSSFSLLLISSSLAFPLLMSVSADAADLTLGSRDSYNGDTSTTEFTPKAATSDASGTTYILDGDVSISQAGKQTSLTTSCFSNTAGNLTFLGNGFSLHFDNIISSTVAGVVVSNTAASGITKFSGFSTLRMLAAPRTTGKGAIKITDGLVFESIGNLDLNENASSENGGAINTKTLSLTGSTRFVAFLGNSSSQQGGAIYASGDSVISENAGILSFGNNSATTSGGAISAEGNLVISNNQNIFFDGCKATTNGGAIDCNKAGANPDPILTLSGNESLHFLNNTAGNSGGAIYTKKLVLSSGRGGVLFSNNKAANATPKGGAIAILDSGEISISADLGNIIFEGNTTSTTGSPASVTRNAIDLASNAKFLNLRATRGNKVIFYDPITSSGATDKLSLNKADAGSGNTYEGYIVFSGEKLSEEELKKPDNLKSTFTQAVELAAGALVLKDGVTVVANTITQVEGSKVVMDGGTTFEASAEGVTLNGLAINIDSLDGTNKAIIKATAASKDVALSGPIMLVDAQGNYYEHHNLSQQQVFPLIELSAQGTMTTTDIPDTPILNTTNHYGYQGNWNNCLGRRCNCKNKKCYLNLD

SEQ ID NO: 19 - protein, 359 aa, Chlamydia pneumoniae
  CPn0017
ILRITMGIKGTGIIVWVDDATAKTKNATLTWTKTGYKPNPERQGPLVPNSLWGSFVDVRSIQSLMDRSTSSLSSSTNLWVSGIADFLHEDQKGNQRSYRHSSAGYALGGGFFTASENFFNFAFCQLFGYDKDHLVAKNHTHVYAGAMSYRHLGESKTLAKILSGNSDSLPFVFNARFAYGHTDNNMTTKYTGYSPVKGSWGNDAFGIECGGAIPVVASGRRSWVDTHTPFLNLEMIYAHQNDFKENGTEGRSFQSEDLFNLAVPVGIKFEKFSDKSTYDLSIAYVPDVIRNDPGCTTTLMVSGDSWSTCGTSLSRQALLVRAGNHHAFASNFEVFSQFEVELRGSSRSYAIDLGGRFGF

SEQ ID NO: 20 - protein, 497 aa, Chlamydia pneumoniae
  CPn0018
EYNMKTSVSMLLALLCSGASSIVLHAATTPLNPEDGFIGEGNTNTFSPKSTTDAAGTTYSLTGEVLYIDPGKGGSITGTCFVETAGDLTFLGNGNTLKFLSVDAGANIAVAHVQGSKNLSFTDFLSLVITESPKSAVTTGKGSLVSLGAVQLQDINTLVLTSNASVEDGGVIKGNSCLIQGIKNSAIFGQNTSSKKGGAISTTQGLTIENNLGTLKFNENKAVTSGGALDLGAASTFTANHELIFSQNKTSGNAANGGAINCSGDLTFTDNTSLLLQENSTMQDGGALCSTGTISITGSDSINVIGNTSGQKGGAISAASLKILGGQGGALFSNNVVTHATPLGGAIFINTGGSLQLFTQGGDIVFEGNQVTTTAPNATTKRNVIHLESTAKWTGLAASQGNAIYFYDPITTNDTGASDNLRINEVSANQKLSGSIVFSGERLSTAEAIAENLTSRINQPVTLVEGSLVLKQGVTLITQGFSQEPESTLLLDLGTSL

SEQ ID NO: 21 - protein, 450 aa, Chlamydia pneumoniae
  CPn0019
ASTEDIVITNLSINADTIYGKNPINIVASAANKNITLTGTLALVNADGAFYENHTLQDSQDYSFVKLSPGAGGTIITQDASQKPLEVAPSRPHYGYQGHWNVQVIPGTGTQPSQANLEWVRTGYLPNPERQGSLVPNSLWGSFVDQRAIQEIMVNSSQILCQERGVWGAGIANFLHRDKINEHGYRHSGVGYLVGVGTHAFSDATINAAFCQLFSRDKDYVVSKNHGTSYSGVVFLEDTLEFRSPQGFYTDSSSEACCNQVVTIDMQLSYSHRNNDMKTKYTTYPEAQGSWANDVFGLEFGATTYYYPNSTFLFDYYSPFLRLQCTYAHQEDFKETGGEVRHFTSGDLFNLAVPIGVKFERFSDCKRGSYELTLAYVPDVIRKDPKSTATLASGATWSTHGNNLSRQGLQLRLGNHCLINPGIEVFSHGAIELRGSSRNYNINLGGKYRF

SEQ ID NO: 22 - protein, 705 aa, Chlamydia pneumoniae
  CPn0020
KLWSNPNLRLMKRCFLFLASFVLMGSSADALTHQEAVKKKNSYLSHFKSVSGIVTIEDGVLNIHNNLRIQANKVYVENTVGQSLKLVAHGNVMVNYRAKTLVCDYLEYYEDTDSCLLTNGRFAMYPWFLGGSMITLTPETIVIRKGYISTSEGPKKDLCLSGDYLEYSSDSLLSIGKTTLRVCRIPILFLPPFSIMPMEIPKPPINFRGGTGGFLGSYLGMSYSPISRKHFSSTFFLDSFFKHGVGMGFNLHCSQKQVPENVFNMKSYYAHRLAIDMAEAHDRYRLHGDFCFTHKHVNFSGEYHLSDSWETVADIFPNNFMLKNTGPTRVDCTWNDNYFEGYLTSSVKVNSFQNANQELPYLTLRQYPISIYNTGVYLENIVECGYLNFAFSDHIVGENFSSLRLAARPKLHKTVPLPIGTLSSTLGSSLIYYSDVPEISSRHSQLSAKLQLDYRFLLHKSYIQRRHIIEPFVTFITETRPLAKNEDHYIFSIQDAFHSLNLLKAGIDTSVLSKTNPRFPRIHAKLWTTHILSNTESKPTFPKTACELSLPFGKKNTVSLDAEWIWKKHCWDHMNIRWEWIGNDNVAMTLESLHRSKYSLIKCDRENFILDVSRPIDQLLDSPLSDHRNLILGKLFVRPHPCWNYRLSLRYGWHRQDTPNYLEYQMILGTKIFEHWQLYGVYERREADSRFFFFLKLDKPKKPPF

SEQ ID NO: 23 - protein, 588 aa, Chlamydia pneumoniae
  CPn0021
CSRSPYPNIEILARGVEHRSMGLFHLTLFGLLLCSLPISLVAKFPESVGHKILYISTQSTQQALATYLEALDAYGDHDFFVLRKIGEDYLKQSIHSSDPQTRKSTIIGAGLAGSSEALDVLSQAMETADPLQQLLVLSAVSGHLGKTSDDLLFKALASPYPVIRLEAAYRLANLKNTKVIDHLHSFIHKLPEEIQCLSAAIFLRLETEESDAYIRDLLAAKKSAIRSATALQIGEYQQKRFLPTLRNLLTSASPQDQEAILYALGKLKDGQSYYNIKKQLQKPDVDVTLAAAQALIALGKEEDALPVIKKQALEERPRALYALRHLPSEIGIPIALPIFLKTKNSEAKLNVALALLELGCDTPKLLEYITERLVQPHYNETLALSFSKGRTLQNWKRVNIIVPQDPQERERLLSTTRGLEEQILTFLFRLPKEAYLPCIYKLLASQKTQLATTAISFLSHTSHQEALDLLFQAAKLPGEPIIRAYADLAIYNLTKDPEKKRSLHDYAKKLIQETLLFVDTENQRPHPSMPYLRYQVTPESRTKLMLDILETLATSKSSEDIRLLIQLMTEGDAKNFPVLAGLLIKIVE

SEQ ID NO: 24 - protein, 216 aa, Chlamydia pneumoniae
  CPn0022
TILQVISNCCNVSNTRSFYSMSLPLVLGSSSPRRKFILEKFRVPFTVIPSNFDESKVSYSGDPIAYTQELAAQKAYAVSELHSPCDCIILTGDTIVSYDGRIFTKPQDKADAIQMLKTLRNQTHDVVTSIAVLHKGKLLTGSETSQISLTMIPDHRIESYIDTVGTLNNCGAYDVCHGGLILKKVHGCVYNVQGLPIQTLKYLLEELNIDLWDYSI

SEQ ID NO: 25 - protein, 548 aa, Chlamydia pneumoniae
  CPn0023
ENRAKLLYSKQHFVMLSAMSIVLDKIGKSLGTRILFDDVSVVFNPGNCYGLTGPNGAGKSTLLKIIMGMIEPTRGSISLPKKVGILRQNIDSFHDTTVLDCVIMGNTRLWEALQRRDNLYLQEFTDAIGMELGEIEEIIGEENGYRADSEAEELLTGIGIPNEMFDKKMAMIPIDLQFRVLLCQALFGHPEALLLDEPTNHLDLYSINWLGNFLKDYEGTVIVVSHDRHFLNTITTHIADIDYDTIIIYPGNYDDMVEMKTASREQEKADIKSKEKKISQLKEFVAKFGAGSRASQVQSRLREIKKLQPQELKKSNIQRPYIRFPLSDKSSGKVVLSLEAITKDYGDHQVIHPFSLEIYQGDKLGIIGNNGLGKTTLMKLLAGVEAPSSGSIKLGHQAICSYFPQNHSDVLADCGQETLFEWLRNRKTGINDQEIRSVLGKMLFGGDDAFKQIQALSGGETARLLMAGMMLENHNVLILDEANNHLDLESVSALSWAINDYKGTAIFVSHDRGLIQDCATKLLIFDKDKITFFDGTMVDYTAGHKQLL

SEQ ID NO: 26 - protein, 315 aa, Chlamydia pneumoniae
  CPn0024
REVMIASIYSFLDYLKMVKSASPHTLRNYCLDLNGLKIFLEERGNLAPSSPLQLATEKRKVSELPFSLFTKEHVRMYIAKLIENGKAKRTIKRCLSSIKSFAHYCVIQKILLENPAETIHGPRLPKELPSPMTYAQVEVLMATPDISKYHGLRDRCLMELFYSSGLRISEIVAVNKQDFDLSTHLIRIRGKGKKERIIPVTSNAIQWIQIYLNHPDRKRLEKDPQAIFLNRFGRRISTRSIDRSFQEYLRRSGLSGHITPHTIRHTIATHWLESGMDLKTIQALLGHSSLETTTVYTQVSVKLKKQTHQEAHPHA

SEQ ID NO: 27 - protein, 309 aa, Chlamydia pneumoniae
  CPn0025
ILMSSRELIILGCSSQQPTRTRNQGAYLFRWNGEGLLFDPGEGTQRQFIFANIAPTTVNRIFVSHFHGDHCLGLGSMLMRLNLDKVSHPIHCYYPASGKKYFDRLRYGTIYHETIQVVEHPISEEGIVEDFGSFRIEAQRLQHQVDTLGWRITEPDTIKFLPKELESRGIRGLIIQDLIRDQEISIGGSTVYLSDVSYVRKGDSIAIIADTLPCQAAIDLAKNSCMMLCESTYLEQHRHLAESHFHMTAKQAATLAKRAATQKLILTHFSARYLNLDDFYKEASAVFPNVSVAQEYRSYPFPKNPLLNK

SEQ ID NO: 28 - protein, 292 aa, Chlamydia pneumoniae
  CPn0026
SNFAMSHLIPSLRNSVTSYFHKPQPIKQAAPSKSIRDICNIAYLIIICVLVVVVLVGAMLCMFIPSVGIPLCLSSLALLVLLSIFNPCLINWISTKKTKEIAPKDASESQPTKSASRKGSPQLSPHHDHEPKNFIRTQLEKGVNYVTNKFKSGEESPHISDEHHSPRQSKRSSEIESSDESSPELHRKAKGKAPHTATTKESKTSTTESSKKKKKTKHSLHRTTSSIHKRSAPKPMVPSKKRKPVLLKKTVPLPIEDLEHQSSGNESSDSSSPPPVQRKAILPWFCKQPTDP

SEQ ID NO: 29 - protein, 825 aa, Chlamydia pneumoniae
  CPn0027
PSIRTIVDSTTNSDSPILDPNPEDVEKLLDESEEESEDQSTERLLPSELFILPLNKRPFFPGMAAPILIESGPYYEVLKVLAKSSQKYIGLVLTKKENADILKVSFNQLHKTGVAARILRIMPIEGGSAQVLLSIEERIRIIEPIKDKYLKARVSYHADNKELTEELKAYSISIVSVIKDLLKLNPLFKEELQIFLGHSDFTEPGKLADFSVALTTATREELQEVLETTNMHDRIDKALILLKKELDLSRLQSSINQKIEATITKSQKEFFLKEQLKTIKKELGLEKEDRAIDIEKFSERLRKRHVPDYAMEVIQDEIEKLQTLETSSAEYTVCRNYLDWLTIIPWGIQSKEYHDLKKAEIVLNKDHYGLDEIKQRILELISVGKLSKGLKGSIICLVGPPGVGKTSIGRSIAKVLHRKFFRFSVGGMRDEAEIKGHRRTYIGAMPGKMVQALKQSQAMNPVIMIDEVDKIGASYHGDPASALLEVLDPEQNKDFLDHYLDVRVDLSNVLFILTANVLDTIPDPLLDRMEILRLSGYILEEKLQIAKKYLVPKARKEIGLTASEVNFQPEALKYMINNYAREAGVRTLNGNIKKVLRKVALKIVQNQEKPKSKKITFKISSKNLQTYLGKPIFSSDRFYESTPVGVATGLAWTSLGGATLYIESVQVSSLKTDMHLTGQAGEVMKESSQIAWTYLHSALHRYAPGYTFFPKSQVHIHIPEGATPKDGPSAGITMVTSLLSLLLETPVVNNLGMTGEITLTGRVLGVGGIREKLIAARRSRLNILIFPEDNRRDYEELPAYLKTGLKIHFVSHYDDVLKVAFPKLK

SEQ ID NO: 30 - protein, 262 aa, Chlamydia pneumoniae
  CPn0028
RMFLQFFHPIVFSDQSLSFLPYLGKSSGIIEKCSNIVEHYLHLGGDTSVIITGVSGATFLSVDHALPISKSEKIIKILSYILILPLILALFIKIVLRIILFFKYRGLILDVKKEDLKKTLTPDQENLSLPLPSPTTLKKIHALHILVRSGKTYNELIQEGFSFTKITDLGQAPSPKQDIGFSYNSLLPNFYFHSLVSVPNISGEERALNYHKEQQEEMAVKLKTMQACSFVFRSLHLPSMQTKDKKAGFGLLTFFPWKIYPL

SEQ ID NO: 31 - protein, 150 aa, Chlamydia pneumoniae
  CPn0029
SNKNERNENIYCFNLFRYIRFFAALNIRMNDGLRFCYSYILLRPMLLDSSLLRKGGQELLKKFQIKLRTTSIKSSLISLRQQLGKREATQSDILYGTSRFQYLNSFEIEDPRIPPTMAAQLQEITWSRSVMELKIKFYVYLNSERNKTKP

SEQ ID NO: 32 - protein, 230 aa, Chlamydia pneumoniae
  CPn0030
LKGVCWYSLFFYIKNRRMYFYKYVIIDTSGYYPFLACVDNQQVLEHWSLPVGPDLGIVLEFLFKSKNLSFQGVAVALGPGNFSATRIGISFAQGLAMAKNVPLLGYSSLEGYLLSKDEKKALMLPLGKRGGVLTLSSEIPEEGLNEKRRGVGPGALLSYEEASDYCVAHGYYHVISPNPQLFASSFSDKITVEEVAPSVEQIRRHVISQFMFVEYDKQLSPDYRSYSCIF

SEQ ID NO: 33 - protein, 59 aa, Chlamydia pneumoniae
  CPn0031
CMPSVKVRVGEPVDRALRILKKKIDKEGILKAAKSHRFYDKPSVKKRAKSKAAAKYRSR

SEQ ID NO: 34 - protein, 406 aa, Chlamydia pneumoniae
  CPn0032
SLIGNVVFVGSVSGMDYYSILGISKTASAEEIKKAYRKLAVKYHPDKNPGDAAAEKRFKEVSEAYEVLSDPQKRDSYDRFGKDGPFAGAGGFGGAGGMGNMEDALRTFMGAFGGEFGGGSFFDGLFGGLGEAFGMRSDPAGARQGASKKVHINLTFEEAAHGVEKELVVSGYKSCETCSGQGAVNPQGIKSCERCKGSGQVVQSRGFFSMASTCPECGGEGRIITDPCSSCRGQGRVKDKRSVHVHIPAGVDSGMRLKMEGYGDAGQNGAPSGDLYVFIDVESHPVFERRGDDLILELPIGFVDAALGMKKEIPTLLKTEGSCRLTVPEGIQSGTILKVRNQGFPNVHGKGRGDLLVRISVETPQNLSEEQKELLRTFASTEKAENFPKKRSFLDKIKGFFSDFTV

SEQ ID NO: 35 - protein, 681 aa, Chlamydia pneumoniae
  CPn0033
ERSMGVVQNQVISSIRDVLKLVWELRFAEHKMLLLSRQSGSGGTFQLSCAGHELAGVLAGKSLIPGKDWSFPYYRDQGFPIGLGCDLSEIFASFLARTTPNHSSARMMPYHYSHKKLRICCQSSVVGTQFLQAAGRAWAVKHSSADEVVYVSGGDGATSQGEFHEMLNFVALHQLPLITVIQNNHWAISVPFEDQCGADLASLGRCHQGLAVYEVDGGNYTSLTETFSHAVDQARQHSVPALILIDVVRLSSHSNSDNQEKYRSALDLKLSMDKDPLILLEKEAINVFGLSPFEIEEIKAEAQEEVRKSCEIAEALPFPSKGSTSHEVFSPYTETLIDYENSESAQNLRNSEPKVMRDAISEALVEEMTRDSGVIVFGEDVAGDKGGVFGVTRNLTEKFGPQRCFNSPLAEATIIGTAIGMALDGIHKPVVEIQFADYIWPGINQLFSEASSIYYRSAGEWEVPLVIRAPSGGYIQGGPYHSQSIEGFLAHCPGIKVAYPSNAADAKALLKAAIRDPNPVVFLEHKALYQRRIFSACPVFSHDYVLPFGKAAIVHPGKDLTIVSWGMPLVLSLEVAQELASRGISIEVIDLRTMVPCDFATVLKSLEKTGRLLVIHEASEFCGFGSELVATMSEQGYAYLDAPIRRLGGLHAPVPYSKVLENEVLPHKESILQAAKSLAEF

SEQ ID NO: 36 - protein, 429 aa, Chlamydia pneumoniae
  CPn0034
VNFLLPTTCRGILMAEISTPSLPDSSIVSQKTPPVPDPDSSPDHIPTIPTQAPFKPQRKKETPSSIVNAIAFAILAFLSCLGGVFAICLGCSLEITMPLFILTAVFIAFTLLYFIHYLEKPKIPEPLPTPPPSPTLRAPTLTPEIPAPAPGIPLPPTLPKVDRTKLTCNPDIHYPSTYDPKACFSLLKQLFSLDPETRPEDRKYSNKLASILLRSKEKSGFRFHCFKGHFSHDKILNKKSGAVVISSHSSMDFSTTLGRAFAVTTCLQRSCWEKIKNNIPTPEKHLPIGSCVSGPWDVEEGAQLYTSHLIVINPPTLETLIKEKMRRAITLKDFSMKEAFTNLVLAYLQCFDICIEHNLESVQLEVFGLNNLSADQEEFTTWESCCHLALLESVRILLASKEEYALSNVSVNSISQVPLQTACRALFLN

SEQ ID NO: 37 - protein, 526 aa, Chlamydia pneumoniae
  CPn0035
ARTTLEEDAGSSLKPLPKTFPCATALYITHRRERKSEHQMWNRCQVFSSFFFRYPISSWLIRLRASCECFQQRHPIFLCGLYWLAGITSRGHPECSALILIFLGMFLPRNPKQWLPLASAWIISLMLTPAPFLHDGPISGTFVIHHAGGQGTYYGEALCIQTPCGKRAHHLSCQILSESRLELKKVYELEGTLHHTSQIVFKSNACYKEIPRSRFYIMKEKCRESSCHFLNHRFPSSEVGPFASSLLLGTPLPQNLRDLFRQKGLSHLFAISGWHFSLCATTLWMLCALLPLKIKKILSFIVLTSLACIFPMSLSVWRSWISVTLLCFSWCFSGSCSGLNRLGAGFILCSIFFSPFSPTFVLSFLATLGILLFFPKIFSFLYTPWTQFLSPFWLYPIRYLAMTLAISLSAQLFIVLPIMQYFGSLPLEGLLYNLIVPFTILPIIVFLIATIILPCCSPITEALIQGFLSHPWLHNPNILKTLSFAPVPPWMLTLASLILFFIGILRTNVSPYASISATSYRFIETL

SEQ ID NO: 38 - protein, 276 aa, Chlamydia pneumoniae
  CPn0036
AKSLWDSERKKMKKPDNDSTFDVRSFFPFDVLCIEQLRKEMSWEVVSAKIPRLPRGWYELMGLSKEDRIDFCLDFWCSVLGIEHKESPSICRFFSLLETIEVYIYRLEKEPYQLKMFYVFRDGRCGFQGEPPLLDFLGHHRLPPLGDRHYEKFFSIHNGFGKWEDEGIFPMRSLAKVQQKLRQQLVVMNKMQAEDNCYSLGIFPFYGYEEPFAYQSFFFDPEIRRDLPSPNVLLNEESLEHRSLETIELLHLSKSYYPSFLSWLENYLHSEEVYNE

SEQ ID NO: 39 - protein, 138 aa, Chlamydia pneumoniae
  CPn0037
KLLSCCICLRAIILLSSRGWRTIYIVRRCIMNEPTRTYLESEKDTQDQIEELQATCIVKNAAGIHVRPAGVIVRLFDGEPCDVHFTYAGKTINAKSIMSILMLGAPQGGEILVTIRSKEAHRILQKIQDAFSSGFGEL

SEQ ID NO: 40 - protein, 571 aa, Chlamydia pneumoniae
  CPn0038
MDTQSSTGNEEWRIAGTSIVSGMALGKVFFLGTSPLHVRELTLPQEEVEHEIHRYYKALNRSKSDIVALEQEVTGQQGLQEVSSILQAHLEIMKDPLLTEEVVNTIRKDRKNAEYVFSSVMGKIEESLTAVRGMPSVVDRVQDIHDISNRVIGHLCCQHKSSLGESDQNLIIFSEELTPSEVASANSAYIRGFVSLVGAATSHTAIVSRAKSIPYLANISEELWNIAKRYNGKLVLIDGYRGELIFNPKPATLQSCYKKELSVVAHTSQRLVRKSLHPIVSSHAGSDKDVEDLLENFPQTSIGLFRSEFLAVILGRLPTLREQVDLYEKLARFPGDSPSVLRLFDFGEDKPCPGIKNKKERSIRWLLDYSVILEDQLQAIAKASLQGSIKVLIPGVSDVSEIIEVKKKWETIRTRFPKGHKVSWGTMIEFPSAVWMIEEILPECDFLSIGTNDLVQYTLGISRESALPKHLNVTLPPAVIRMIHHVLQAAKQNQVPVSICGEAAGQLSLTPLFIGLGVQELSVAMPVINRLRNHIALLELNSCLEITEALLQAKTCSEVEELLNRNNKITS

SEQ ID NO: 41 - protein, 98 aa, Chlamydia pneumoniae
  CPn0039
ISMGSGYAKKKKEAKIMEQQFLEMEASLLEKRYEGQAGNGLVSVVINGKCDLISVKVQPTCLDPEDPEVIEDLFRAAFKLAKEQMDQEMSLMRSTMPF

SEQ ID NO: 42 - protein, 452 aa, Chlamydia pneumoniae
  CPn0040
AFYTHSLGYTMTLQPYQASSRKYRPQIFREILGQSSVVAVLKNALVFNRAAHAYLFSGIRGTGKTTLARILAKALNCVHLSEDGEPCNQCFSCKEIASGSSLDVLEIDGASHRGIEDIRQINETVLFTPVKAKFKIYIIDEVHMLTKEAFNALLKTLEEPPQHVKFFFATTEIHKIPGTILSRCQKMHLQRIPEKTILEKLSLMAQDDHIEASQEALAPIARAAQGSLRDAESLYDYVISLFPKSLSPDTVAQALGFASQDSLRTLDNAILQRDYATALGIVTDFLNSGVAPVTFLHDLTLFYRNLLLTNSTTSKFSSQYKTEQLLEIIDFLGESAKHLQNTIFEQTFLETVIIHIIRIYQRPVLSELISSIKSRQFEGLRNIKEPTLTQQVSAPQPQPTYKEQSFLEKKNQPAAEGKIISVEVKSSASIKSAAVDTLLQFAVVEFSGILRQ

SEQ ID NO: 43 - protein, 485 aa, Chlamydia pneumoniae
  CPn0041
CKYLYHHSYPPPQHSVGSISSRYKLRVLAITFLVLGVLLLISGALFLTLGIPGLTAGVSFGLGIGLSALGGVLVVSGLLCLLVKREVSKVCPEEIPAVQPEETPEGVPVTPFEKPALDEAQKEQKTQKILDQLPQELDQLDRYIQEAFACLGPLKDLKYEDQGFLQDVKEEFQVFDFVQKDMIAEFVELQQILCQEGRLLEFVINQTRYIGRDLFKREDSLYKLWEWLGYLPSGDVRGERLKKSAREVVDRFMRTTCNIRKIAMTFDRHVYSVAKTAFEKAFGALETCVYESMRESYREAFCEYEKAKLLGDEEKSAHAEQRFQDIKNRWEDVKDAFFWVKEDGKIEIDDAIGNSCKWSERYEEHRITRARWYKVAEHQLFNATMRVKDSLREHNEARVAFEKERSKENQRQVQKKKEKRLRDLKELHDQELPRAQERLRELQALYPEIAVSVVEARREVASDLEKAHESIDKHYQSCVREQELY

SEQ ID NO: 44 - protein, 279 aa, Chlamydia pneumoniae
  CPn0042
EEEEKQEAEFRENGTKIRSMEEVSEYLQQVENQLESCSKRLTKMETFALGVRLEAKEEIESIILSDVVNRFEVLCRDIEDMLSRVEEIERMLRMAELPLLPIKEALTKAFVQHNSCKEKLTKVEPYFKESPAYLTSEERLQSLNQTLQRAYKESQKVSGLESEVRACREQLKDQVRQFETQGVSLIKEEILFVTSTFRTKFSYHSFRLHVPCMRLYEEYYDDIDLERTRARWMAMSERYRDAFQAFQEMLKEGLVEEAQALRETEYWLYREERKSKKKH

SEQ ID NO: 45 - protein, 647 aa, Chlamydia pneumoniae
  CPn0043
HHRFIMQVPLSPQLPPPPPDHSVGASFCLSKFRVLAITFLVLGVLLLISGALFLTLGISGVSLGVGLGLSALGSVLVISGFLLLLERREVSGVGLEGIPTGIPVGPSAEPSSEEIQKKQKAKQILDQLPQELDQLDTDIQHVLSCLGKLKDLKCKDRGLLKDAKEKLQVFDFVWKDMMMEFVELQQVMDQESRYLEGLIHEVQSIAHKLFVDDVNIRSHLGESCGYLPSEDVRGELLKRFAKEVVARFMKVTRDIRKIAMAFNKNAYGAAKNAFDKAFGSLETCLYKSLTKSYRDTFCDYKRAKILPDENNSARAEQRFREVKDHWEDLKETVFWVKEDGRIDIEVLTAVGGWPDRYPEHLILEKRKDKVMSHQLWEATMRVKEAEVTYSVARVAFEKDGSQQNQKKFQEKTKERLRCLKDLRDQECHRAQERLEKLTALYPEVSVSVVETERERKFNLEKAYGNLEERYQSVVQDQEDYWTEQKNREAEFRAKGTKVRSMEEVAEHLQILENLLEDCYKRLSKAETFALGVEREATEEIEYTILSDAANRLKVLCEDIEDTLPRVEEIEMMLRMAERPLHPIKQAFTKAFVQYNRCKERLAKVEPYYKESPAYVNSEERLQSLDQASQCIQRVPKGFKFRNGSMYI

SEQ ID NO: 46 - protein, 167 aa, Chlamydia pneumoniae
  CPn0044
IAKSDCRVWIRLHSAYKESQKVSSLETEACTYREYLREQVQQFETQGVSLIKEELLFLSSTLKSKLSYDPLIANIPCMKFYYQYYDDIDKARAQSRWLEKSERYRNAKRRFQEIVKKGLFKEAKPLKKEEYRLLQEERSNKEKRLIYNKMAVARQRVQEFESMEIPE

SEQ ID NO: 47 - protein, 610 aa, Chlamydia pneumoniae
  CPn0045
CKYTYHPPQLPPDHSVGATSWQPKLRILTITFLVLGVLLLISGALFLTLGVPGLAAGLSFGLGIGLSALGGVLVVSGLLFFLIRRGVSKVRPEEIPVTPSHEAQKILCQLPQELDQLDTSIQEVVSCLGKLKDLKYEDQGLLTEVQEKLRVFDFVRKDMVTEFLELQQVVAQEGQFLDYLINQVQSISHKLFVPDVNIGAHLAELCGYLPSGDVRVERLKRSARQVVDRFMRVTCDTRKVAMAFDENACGVAKNAFDKAFGALEECVYKSLTESYREAFYEYEKAKILRNEDVEWLQDKNKSARAEQRFREVKDRWEDLKETVFWVKENGCIDLEVLTAVGGWPDRGPEHLIPEKRRNKVMSHKLWEATMRMKGAEGTYSVARVAFEKDGSRKNQKKFQEKTKEWLRCLKDLHDQECHRARERLAELEALYPEVSVSVVETERETKFKLETAYGNLEERYQSVVRDQEDYWKEEENKEAEFREKGTKVRSPEEVVEYLQILENLSEDCSKQLTIAEVVVLGVELEATAEFEYTILSDAANRLKVLCEDIEDILPRVEEIEIMLRIAELPFLPIKQAFTKAFLQYNSCKDKLAKVEPYCQESVDYKSGFRV

SEQ ID NO: 48 - protein, 163 aa, Chlamydia pneumoniae
  CPn0046
ERFQSLNQDLQNVYQECQKATGLESEVSAYRDHLREQITEFETQGLDVIKEELLFVSSTLKSKLSYDPLIADIPCMKFYEEYYDGIDKARVQSRWLEKSERYRKAKKGFQEMLKEGLFKEDQALKKAEYRLLREKRMNKEKLLICNKIEAAQQRVQEFGPSDS

SEQ ID NO: 49 - protein, 72 aa, Chlamydia pneumoniae
  CPn0047
EHFHLKVTIVGFFRFVLEGILTMYHFQKIRMTLTTQGFVLNKSLRKDYELWFVYGSCPESKVKLQTSSHKWL

SEQ ID NO: 50 - protein, 705 aa, Chlamydia pneumoniae
  CPn0048
MKELRHESYNRALHKLSHQWVRYFLYTFVSCSFIVAIFTFAWLKVLYVPEYKAGEISRISLTAPMDFSLSWSAHKFYKRTAHISEAFGKVYHLTLSPGSLLSKEGNADENTDYWFKKAADFLLSTNFVDSSTQKCLKDLCIYPPLLGKEKKTLEININSNKGNVIAQCFCHLKIFLIQENCPQPCFDAIMDILKIANFEVAVDKEMSGCVKGELLGKRCIEKITKGTPILEKYQRIDDRDAKILKQLRAQLLSVHTLFSCRSLWGAIFVVLLILLWGYGALKALCPEMLKSPQRFMLYIAILTLSLLWCRGTEIFCAYWVSYLSYPPILPFTAVLLGYFLGLPIAGFSCTFLALLYTLGSDLWNNSWFLSINLLCSWRILVSLHRVSRLSSVFWACMKLGGVAMGSLLMFRIFTNTISREALYADGIESFVYSLITAISVVALIPVFEASFGASTNFSLLTYLSPENALLKRLFKEAPGTYQHSVLVGSLAEAAAQAIGADSLYCLVAAHYHDIGKLINPGFFSENQKILQQSGHSLSPLECAKMIMRHIPEGVNLARQAGLPESFIQVIEEHHGTSVIRSAYYSHMVENPSTGSFDEELFRYSGNKPSSKETTIIMIADSFEAASRSLKNASLPDLQRLIDQIIQGKLQDGQFSCSPITLDELALISKSMVQTLYGALHSRMKYPEISYQISMDSCPKPSIGGT

SEQ ID NO: 51 - protein, 182 aa, Chlamydia pneumoniae
  CPn0049
LKEKRRNIVYLLVIYQEIFWLTMLHQPYYDKILTGNTIYIPGHTHKDSNKLFQKKSRAIWVDEKPFSLDCFSNVFLIFVSLVPIAGLVRAYQIKKSLDRTTVQIGYSPSLSCEQKECVEAFVNGYGLICISILGGLGILVPILILVVLSLLLLGILMLFSLSTYESIKNYISKHICWKSNAT

SEQ ID NO: 52 - protein, 117 aa, Chlamydia pneumoniae
  CPn0050
VSWFPILGIFLAMRYAKHQTNWNDENVKANLGYLPSTNCKNALCRMSSRLTSSIKTAGILGGCGILLPIFLLLLAILLISVLFQLIMLPFRLCCFALRQSVSSDTVTNLLLLNNTLA

SEQ ID NO: 53 - protein, 105 aa, Chlamydia pneumoniae
  CPn0051
CFAYLIARNIPRMGNHETYIHPGVLPSSHAQDVSRSTVYPSRSFIMRRMLMGWNFNRVPSKSSEQLMDGHRIPLIFFGKHHPTISILNVNRFSWLSIFYNGERGF

SEQ ID NO: 54 - protein, 235 aa, Chlamydia pneumoniae
  CPn0052
KMLSVCYSDPCLSDFCQGKRPLRIASRNSNLAKAQVHECISLLRSWYPKLWFQLSTTETTGDREKKIPLHLVENSYFFTDGVDALVHKGVCDLAIHSAKDLPETPSLPVVAITRCLHPADLLVYADHYVHEPLPLSPRLGSSSLRRSAVLKQLFPQGQILDIRGTIEERLDQLHRGHYDAIVLAKAASLRLHLHHAYSIELPPPYHALQGSLAITAKDHAGKWKQLFTPIHCHSS

SEQ ID NO: 55 - protein, 455 aa, Chlamydia pneumoniae
  CPn0053
IRMATKTKTQWTCNQCGATAPKWLGQCPGCHNWNSLVEEYVPQARSGTSSRSSTSAIALSSIELENESRIFIDHAGWDRILGGGVVRGSLTLLGGDPGIGKSTLLLQTAERLASQKYKVLYVCGEESVTQTSLRAKRLNISSPLIYLFPETNLDNIKQQIATLEPDILIIDSIQIIFNPTLNSAPGSVAQVREVTYELMQIAKSAQITTFIIGHVTKSGEIAGPRVLEHLVDTVLYFEGNSHANYRMIRSVKNRFGPTNELLILSMHADGLKEVSNPSGLFLQEKTGPTTGSMIIPIIEGSGALLIELQALVSSSPFANPVRKTAGFDPNRFSLLLAVLEKRAQVKLFTMDVFLSITGGLKIIEPAADLGALLAVASSLYNRLLPNNSIVIGEVGLGGEIRHVAHLERRIKEGKLMGFEGAILPEGQISSLPKEIRENFRLQGVKTIKDAIRLLL

SEQ ID NO: 56 - protein, 259 aa, Chlamydia pneumoniae
  CPn0054
TLSFFPPIKIPNSKFKDGALLSMHPPIDITAIEAKLNFTFTQPKLLEIALTHPSYKNESAVQIEDSERLEFLGDAVLGLIVTEHLFLLFPSMDEGTLSTARASLVNAKACCRYTTMLGIGDYLLIGKGEKIQSERGRLSAYANLFESILGAVYLDGGLSPARKLTVPLLPPREEILPLMSGNPKNLLQQFTQKQFRVLPVYQSTAVTDAQGNVSYQIQVLVNQEVWGEGNASSKKEAEKIAAQQALDTYGNKNQNTMDV

SEQ ID NO: 57 - protein, 165 aa, Chlamydia pneumoniae
  CPn0055
CFWICYLIRIRMRSALHLQHLRHFHNHGSILFENLLTIKDCFLLETKLQNFIAKASKTIDTVRWRENIFRSMPEIYTVVRKRRLDFFAAELVHRPKLSLVRDLWVFPGEEILEGEEDCMLFLLLSGDRAGSGIFFTGPYPSDLYELEKGTTGLLLAFSSVGIPVI

SEQ ID NO: 58 - protein, 610 aa, Chlamydia pneumoniae
  CPn0056
EFLKLSLHRISLMKEVEQRIRSLYDAVTAENICRWLSNDCTQQDAKTILGWLDTDPAQLEDLFGATLTFGTGGLRSLMGIGTNRINLFTIRRTTQGLVQVLRAHLPHPGDPMRVVVGCDTRHNSIEFAQETAKVLAGNGCEVFLFQYPEPLALVSFTVRYERAIGGVMITASHNPPNYNGYKVYMASGGQVLPPLDQEIVAACSAVNEILSVPSIDHPNIHLIGKEYEALYRDTLKQLQLYPEANRISGRSLSISYSPLHGTGISLVPHVLKDWGFLSVHLVEKQAIGDGDFPTVQLPNPEDPEALTLGIEQMLANDDDLFIATDPDADRVGVVCLEDGQPYRFNGNQMASLLADHILGAWSKTRHLGEHDKLVKSLVTTEMLSAIAKHYHVDLINVGTGFKYIGEKIESWRNSTNKFVFGAEESYGCLYGTHVEDKDAIIASALIAEAALQQKLQGKTLCDALLSLYETYGYFANKTESVVFSAKTDEQEIRKKLSHLEEISSANFFSGKYQVEKFENYKQGIGFNLLSKDSYALTLPKTSMLCYYFSGGGRVIIRPSGTEPKIKFYFEMSTHYPERVTDKEIQKQREAESFQHLDDFIFDFKEKFSNL

SEQ ID NO: 59 - protein, 214 aa, Chlamydia pneumoniae
  CPn0057
ILKRYVVMSFVPYSLPELPYDYDALEPVISSEIMILHHQKHHQIYINNLNAALKRLDAAETQQNLNELIALEPALRFNGGGHINHSLFWETLAPIDQGGGQPPKHELLSLIERFWGTMDNFLKKLIEVAAGVQGSGWAWLGFCPAKQELVLQATANQDPLEPLTGKLPLLGVDVWEHAYYLQYKNVRMDYLKAFPQIINWGHIENRFSEIISSK

SEQ ID NO: 60 - protein, 312 aa, Chlamydia pneumoniae
  CPn0058
IRWLVRLFSYDKPKIKVQKIKADGFSGWLKCNHCHEMIHANELGQNYNCCPKCSYHYRITAIERVKLLADKDSWRPLYTDLKSQDPLEFIDTDTYANRLEKARKNTTESEGVIVGICTIGLHPVALAVMDFNFMAGSMGAVVGEKLTRLIEEAIETRLPVIIVSASGGARMQESVFSLMQMVKTSAALAKLHEAGLPYISVLTNPTSGGVTASFAALGDIIIAEPKALICFAGPRVVAQVIGEDLPEGAQKSEFLLEHGMIDKIVERKELKTTLQTLLDYFLAQEYTGGKSKAPRDLSKRLKEIFLLTDDSE

SEQ ID NO: 61 - protein, 163 aa, Chlamydia pneumoniae
  CPn0059
IKHHTASCNDNIICNAILMTVFCELDSGGELPEYTTPGAAGADLRANIEEPIALLPGQRALIPTGIKAEIPEGYELQVRPRSGLALKHGITVLNSPGTIDSDYRGEIRVILINFGDSTFIIEPKMRIAQVVLSPVVQATFVVKQESLAETARGSGGFGHTGAS

SEQ ID NO: 62 - protein, 175 aa, Chlamydia pneumoniae
  CPn0060
RKLPEEVEVLVILEQAKMPSYCQNQQDFSLFSLLSPRLVMFLGKHSRDEILQDLTDLVDAAGLLEDKQAFFDALVRRENIMSTGIGMGVAIPHGKLESCSNFFIAIGIHTQGILWDAIDGALVRLVFLIGGPENAQAEYLKLLSTLTLSLREESRRQQLLQVNTIEEVMNVFVGM

SEQ ID NO: 63 - protein, 236 aa, Chlamydia pneumoniae
  CPn0061
RSHECICGDVKMDLKLDEVASLLDVSEHTVLQWLKEGAIPSYSMNNEYRFSREEIENWLLHNQALMIQERGEDKEALKDLSLKYSLYKAIHRGGVLCDVVVHSKEEALQYASKYIAQKFQLDESVLFEMLSHRENLMSTGIGEGIALPHAKDFLINAYYDIVVPMFLAEPIEYGALDGKPVGILFFLFACQDKSHLNLVNKIVHLGMSLNARSFFKNYPNKDQLLAYVKEWESQTH

SEQ ID NO: 64 - protein, 480 aa, Chlamydia pneumoniae
  CPn0062
KKSFCCYGDPHRLPGDCSRMMSSKRTSKIAVLSILLTFTHSIGFANANSSVGLGTVYITSEVVKKPQKGSERKQAKKEPRARKGYLVPSSRTLSARAQKMKNSSRKESSGGCNEISANSTPRSVKLRRNKRAEQKAAKQGFSAFSNLTLKSLLPKLPSKQKTSIHEREKATSRFVNESQLSSARKRYCTPSSAAPSLFLETEIVRAPVERTKELQDNEIHIPVVQVQTNPKEQNTKTTKQLASQASIQQSEGTEQSLRELAQGASLPVLVRSNPEVSVQRQKEELLKELVAERRQCKRKSVRQALEARSLTKKVARGGSVTSTLRYDPEKAAEIKSRRNCKVSPEAREQKYSSCKRDARANGKQDKTTPSEDASQEEQQTGAGLVRKTPKSQVASNAQNFYRNSKNTNIDSYLTANQYSCSSEETDWPCSSCVSKRRTHNSISVCTMVVTVIAMIVGALIIANATESQTTSDPTPPTPTP

SEQ ID NO: 65 - protein, 53 aa, Chlamydia pneumoniae
  CPn0063
PMYANCKHNCLCLYDFSRHRSPPGLPLTFTPPYSFTLGIFLGRCLSTSNIVLL

SEQ ID NO: 66 - protein, 79 aa, Chlamydia pneumoniae
  CPn0064
LVMTKIQCSAQYYRSRPAERAQTPPQPFLARDRADFWERHPRFSACCRVLLLVAWVVLALLFLFVMLLPLAAGSYLLAF

SEQ ID NO: 67 - protein, 590 aa, Chlamydia pneumoniae
  CPn0065
YDYYKYNMFFKKNYMTDFPTHFKGPKLNPIKVNPNFFERNPKVARVLQITAVVLGIIALLSGIVLIIGTPLGAPISMILGGCLLASGGALFVGGTIATILQARNSYKKAVNQKKLSEPLMERPELKALDYSLDLKEVWDLHHSVVKHLKKLDLNLSKTQREVLNQIKIDDEGPSLGECAAMISENYDACLKMLAYREELLKEQTQYQETRFNQNLTHRNKVLLSILSRITDNISKAGGVFSLKFSTLSSRMSRIHTTTTVILALSAVVSVMVVAALIPGGILALPILLAVAISAGVIVTGLSYLVRQILSNTKRNRQDFYKDFVKNVDIELLNQTVTLQRFLFEMLKGVLKEEEEVSLEGQDWYTQYITNAPIEKRLIEEIRVTYKEIDAQTKKMKTDLEFLENEVRSGRLSVASPSEDPSETPIFTQGKEFAKLRRQTSQNISTIYGPDNENIDPEFSLPWMPKKEEEIDHSLEPVTKLEPGSREELLLVEGVNPTLRELNMRIALLQQQLSSVRKWRHPRGEHYGNVIYSDTELDRIQMLEGAFYNHLREAQEEITQSLGDLVDIQNRILGIIVEGDSDSRTEEEPQE

SEQ ID NO: 68 - protein, 580 aa, Chlamydia pneumoniae
  CPn0066
GVYMANPTQSRPPSPEISIEELELQELAGSSNTETISNTPPPSCAATAEEVSLFIEGGRRNSEDEEGPLGSCEVYDVVCITNQGDPEVRDHEVRVMYINGSGRTQHEGILDAMNICDLRGEPVRFIHNSGYGLGSCFLGIRNRIPPRDNVISQAIQARWNEFFIFAENANRDYIVLFSGNGGLYLQVALDNSIYSHHILCVGIGSSYYIQGNYRVHNYRVTGDWTTLLDRRGATAVNTTTLPYADSAEGLFLPSVRCPSYQWALRCGEQCLIMDNNQQVGFRPQDSSSEIALVVNLNQDHSTWTRLIEWIDRGDSQAVLELNPQPSHCRDIALTALYATTRISSLLQECLMISVTYAPEVFVTYAIVTGYSIMTLRYFILLLTNRPGCRRHFRVLRLAALGLQSLGFLTVLLDHINVTRRVNRRPPLISVIFCTASFATGSFIYVDLTRMFFTSLRSRLQLFVQRRLTGRGLPLRRVFVNHLDSLRFSQNALITFHGGLFMPLIIGFFNQLVIQVPRVVIRPNTTAVYDLNQTSQEAWDSGDVLAIGQTINFLLCMILLVINTFFFVRSVRRNLHRRPHR

SEQ ID NO: 69 - protein, 378 aa, Chlamydia pneumoniae
  CPn0067
KGSGYSYRGPPMAVEGRVNSSQALNQDCQEVLANKQSKGLLRCRILSIVVAVITFIAGVVLIALTLASILTSVPYLALGVFLLIVTLGCIIFALCSEKIKKVPPTPISHKEEIIAWFEERKNIDMEKEKEDPEHFGRTATDIPMRSALDQFNHSCHHIHESPALTETYRSHQDVLLFKDWCPVTLPDVTSEEEVLIRSVVGSYLLMEACVPKVSMLIDELHNKLKSPSERECLFIDKKTLQRKASFLFTQKDLATFFLAYTRVNDGHLAPFRAGAKWILIHYVRLRRQHNQNDFFTPGHSCYYARLAFNQTQRLYHQLFNVEKLRSIYANMDKDPLCHPWAFIPIYDLLKTEDHGDGFLEQQEDREYPSRAAQDQFWG

SEQ ID NO: 70 - protein, 193 aa, Chlamydia pneumoniae
  CPn0068
SFMIKKFFIYSLIFSCSFSAPLKGICNEDVSSQSRIEEDPEVLITQLNELIETPIEEGKEIRNELQAISDGQKSSEEIEESCGTSDSEGLSEKTDKESSNEYVLDFFDSMVQRLEGISKMCQSGQVAQIIDCFNREFDIRNRELELKNRELELREKDLEFKKSILDWNKEKVSRELAFQREQDIKQTLMLLKK

SEQ ID NO: 71 - protein, 632 aa, Chlamydia pneumoniae
  CPn0069
LNFLYVYLLIFNLGIMTTPPPSRSSSPPPYDWIELQDLGNTNNNSSRATPPPPEVGGELPPYFSASNFVVIERGAPSLPSPQQLLSLPEYSRQPPPGYFDETASITSRTSEEMFGTLVSTLCCPANSERDWEDHEVNCIYIASTSDTQLEAVQGGMHITELRGEPVRVLYETGHLYAFARENTCHSRLEVSHTVRAMTYFWDRFFSRHWNVGRRFLVFYQGNGGAYVQAALDSSMHTQDIYVLGLSPTVYIRGNYHVQHYRVRGFWPSCLDSLAACAENTSVLPYGESSDGIFYPSLFSHTFDNAIRYGERCLLVCSEGMGMLPETQQQTSPLTSLEGGHEVALVLNPQQNPEALSIASRLMHEERGGRLESNYMPGRSSNPFMTSMYVLVRLNTLAQIYLMSPYYSFQSNDIVCLIFISSAAVETVSYIFLTVTDSTCGRRYLRVPRLVCTGLRNLALPTTLLELLILSYPRSVEGVPFNVRFILGYMCTTRVVFFAWNLILHWPFRCLRHGIQLFVHRSIIGHTLGARITDLTLASMRYAIVFPSIVSSCLLTALAHANTNILALDPYRLIESGDLRRPAFNDDEMQQADNPWDAYSIGLVINTCIYMLILFANLIFMVYSVRRYHRSRR

SEQ ID NO: 72 - protein, 64 aa, Chlamydia pneumoniae
  CPn0070
YKVGLFHLKNQNFFSNQSRTYEQRFPKVSPHFESILRLQSVGFSSQGTLLISFRDTELKRDLYI

SEQ ID NO: 73 - protein, 156 aa, Chlamydia pneumoniae
  CPn0071
IKSLRSILEFICPLQHARCLKKQHKIIEELFPEPFQKDHLYLKLMENSSSRDAFDKKRMLKENLVVGCQSDLYLYEVYQDGILFFFTYTKALMSSGIASLFTEVYSGETPSTILTCKPIFFQRLTPYLSFGRLNGGESLYMRMKQIAVQYLKPPQT

SEQ ID NO: 74 - protein, 365 aa, Chlamydia pneumoniae
  CPn0072
RGYRSTKTSVYKEKVLILIYCLLFYFFHYRMSTPLSSGGISPSDQYVPQELFCDRLSSSRSNSPDSNASGDSPIVSPPISALVALTDLKLVPYNQNSFSWTTRLKNAVEKIGLFLQRNWKYILLYILAWALILVCHHTVALTLTIWLGVGLGIGVVFGIFTATCLDKENKHRHVNSLWNLINHGILQLDPNGTRQILLATMIASISALIYAVPQAVGLVIGFSIGNQLSINTVYGARLGDEATYAIDRKAHKKRIENIEQAINQHQIIKHQMINQKQLNALIEINRNNQTDPATANLLASLKLNLNQPMPYCFSMPECGVTSSYLDLNNNSPDDIIARADQCIMTLSQTLQQIKKEPDRIIESNH

SEQ ID NO: 75 - protein, 74 aa, Chlamydia pneumoniae
  CPn0073
SMAKKEDTLVLEGKVEELLPGMHFRVILENGMPVTAHLCGKMRMSNIRLLVGDRVTVEMSAYDLTKARVVYRHR

SEQ ID NO: 76 - protein, 398 aa, Chlamydia pneumoniae
  CPn0074
EDFEMSKETFQRNKPHINIGTIGHVDHGKTTLTAAITRALSGDGLASFRDYSSIDNTPEEKARGITINASHVEYETPNRHYAHVDCPGHADYVKNMITGAAQMDGAILVVSATDGAMPQTKEHILLARQVGVPYIVVFLNKVDMISQEDAELIDLVEMELSELLEEKGYKGCPIIRGSALKALEGDANYIEKVRELMQAVDDNIPTPEREIDKPFLMPIEDVFSISGRGTVVTGRIERGIVKVSDKVQLVGLGETKETIVTGVEMFRKELPEGRAGENVGLLLRGIGKNDVERGMVVCQPNSVKPHTKFKSAVYVLQKEEGGRHKPFFSGYRPQFFFRTTDVTGVVTLPEGTEMVMPGDNVELDVELIGTVALEEGMRFAIREGGRTIGAGTISKINA

SEQ ID NO: 77 - protein, 88 aa, Chlamydia pneumoniae
  CPn0075
SRSWFMKQQHNRKALSRKIGTVKKQAKFAGSFLDEIKKIEWVSKHDLKKYIKVVLISIFGFGFAIYFVDLVLRKSITCLDGITTFLFG

SEQ ID NO: 78 - protein, 190 aa, Chlamydia pneumoniae
  CPn0076
QPFCSVNCMYKWYVVQVFTAQEKKVKKALEDFKESSGMTDFIQEIILPIENVMEVKKGEHKVVEKYIWPGYLLVKMHLTDESWLYVKSTAGIVEFLGGGVPVALSEDEVRSILTDIEEKKSGVVQKHQFEVGSRVKINDGVFVNFIGMVSEVFHDKGRLSVMVSIFGRETRVDDLEFWQVEEVAPGQESE

SEQ ID NO: 79 - protein, 160 aa, Chlamydia pneumoniae
  CPn0077
FFVSYPLFVEVSQCKVRFSMSVKKVIKIIKLQIPGGKANPAPPIGPALGAAGVNIMGFCKEFNAATQDKPGDLLPVVITVYADKTFTFITKQPPVSSLIKKTLNLESGSKIPNRNKVGKLTQAQVEAIAEQKMKDMDIVLLESAKRMVEGTARSMGIDVE

SEQ ID NO: 80 - protein, 236 aa, Chlamydia pneumoniae
  CPn0078
SCRIMTKHGKRIRGILKNYDFSKSYSLREAIDILKQCPPVRFDQTVDVSIKLGIDPKKSDQQIRGAVFLPNGTGKTLRILVFASGNKVKEAVEAGADFMGSDDLVEKIKSGWLEFDVAVATPDMMREVGKLGKVLGPRNLMPTPKTGTVTTDVAKAISELRKGKIEFKADRAGVCNVGVGKLSFESSQIKENIEALSSALIKAKPPAAKGQYLVSFTISSTMGPGISIDTRELMAS

SEQ ID NO: 81 - protein, 173 aa, Chlamydia pneumoniae
  CPn0079
RGKMKQEKTLLLQEVEDKISAAQGFILLRYLRFTAAYSREFRNSLSGVSAEFEVLKKRIFFKAIEAAGLEVDCSDTDGHLGVVFSCGDPVSAAKQVLDFNKQHKDSLVFLAGRMDNASLSGAEVEAVAKLPSLKELRQQVVGLFAAPMSQVVGIMNSVLSGVISCVDQKAGKN

SEQ ID NO: 82 - protein, 134 aa, Chlamydia pneumoniae
  CPn0080
VRVTKVTTESLETLVEKLSNLTVLELSQLKKLLEEKWDVTASAPVVAVAAGGGGEAPVAAEPTEFAVTLEDVPADKKIGVLKVVREVTGLALKEAKEMTEGLPKTVKEKTSKSDAEDTVKKLQDAGAKASFKGL

SEQ ID NO: 83 - protein, 1266 aa, Chlamydia pneumoniae
  CPn0081
FREILSHQNSRRTRMLKCPERVSVKKKEDIPDLPNLIEIQIKSYKQFLQIGKLAEERENIGLEEVFREIFPIKSYNEATVLEYLSYNLGVPKYSPEECIRRGITYSVTLKVRFRLTDETGIKEEEVYMGTIPLMTDKGTFIINGAERVVVSQVHRSPGINFEQEKHSKGNILFSFRIIPYRGSWLEAIFDINDLIYIHIDRKKRRRKILAITFIRALGYSSDADIIEEFFTIGESSLRSEKDFALLVGRILADNIIDEASSLVYGKAGEKLSTAMLKRMLDAGIASVKIAVDADENHPIIKMLAKDPTDSYEAALKDFYRRLRPGEPATLANARSTIMRLFFDPKRYNLGRVGRYKLNRKLGFSIDDEALSQVTLRKEDVIGALKYLIRLKMGDEKACVDDIDHLANRRVRSVGELIQNQCRSGLARMEKIVRERMNLFDFSSDTLTPGKVVSAKGLASVLKDFFGRSQLSQFMDQTNPVAELTHKRRLSALGPGGLNRERAGFEVRDVHASHYGRICPIETPEGPNIGLITSLSSFAKINEFGFIETPYRIVRDGIVTDEIEYMTADVEEECVIAQASASLDEYNMFTEPVCWVRYAGEAFEADTSTVTHMDVSPKQLVSIVTGLIPFLEHDDANRALMGSNMQRQAVPLLKTEAPVVGTGLECRAAKDSGAIVVAEEDGVVDFVDGYKVVVAAKHNPTIKRTYHLKKFLRSNSGTCINQQPLCAVGDVITKGDVIADGPATDRGELALGKNVLVAFMPWYGYNFEDAIIISEKLIREDAYTSIYIEEFELTARDTKLGKEEITRDIPNVSDEVLANLGEDGIIRIGAEVKPGDILVGKITPKSETELAPEERLLRAIFGEKAADVKDASLTVPPGTEGVVMDVKVFSRKDRLSKSDDELVEEAVHLKDLQKGYKNQVATLKTEYREKLGALLLNEKAPAAIIHRRTAEIVVHEGLLFDQETIERIEQEDLVDLLMPNCEMYEVLKGLLSDYETALQRLEINYKTEVEHIREGDADLDHGVIRQVKVYVASKRKLQVGDKMAGRHGNKGVVSKIVPEADMPYLSNGETVQMILNPLGVPSRMNLGQVLETHLGYAAKTAGIYVKTPVFEGFPEQRIWDMMIEQGLPEDGKSFLYDGKTGERFDNKVVIGYIYMLKLSHLIADKIHARSIGPYSLVTQQPLGGKAQMGGQRFGEMEVWALEAYGVAHMLQEILTVKSDDVSGRTRIYESIVKGENLLRSGTPESFNVLIKEMQGLGLDVRPMVVDA

SEQ ID NO: 84 - protein, 1410 aa, Chlamydia pneumoniae
  CPn0082
CSSYGRRRLKNDVLEKIMFGENSRDIGVLSKEGLFDKLEIGIASDITIRDKWSCGEIKKPETINYRTFKPEKGGLFCEKIFGPTKDWECCCGKYKKIKHKGIVCDRCGVEVTLSKVRRERMAHIELAVPIVHIWFFKTTPSRIGNVLGMTASDLERVIYYEEYVVIDPGKTDLTKKQLLNDAQYREVVEKWGKDAFVAKMGGEAIYDLLKSEDLQSLLKDLKERLRKTKSQQARMKLAKRLKIIEGFVSSSNHPEWMVLKNIPVVPPDLRPLVPLDGGRFATSDLNDLYRRVINRNNRLKAILRLKTPEVIVRNEKRMLQEAVDALFDNGRHGHPVMGAGNRPLKSLSEMLKGKNGRFRQNLLGKRVDYSGRSVIIVGPELKFNQCGLPKEMALELFEPFIIKRLKDQGSVYTIRSAKKMIQRGAPEVWDVLEEIIKGHPVLLNRAPTLHRLGIQAFEPVLIEGKAIRIHPLVCAAFNADFDGDQMAVHVPLSVEAQLEAKVLMMAPDNIFLPSSGKPVAIPSKDMTLGLYYLMADPTYFPEEHGGKTKIFKDEIEVLRALNNGGFIDDVFGDRRDETGRGIHIHEKIKVRIDGQIIETTPGRVLFNRIVPKELGFQNYSMPSKRISELILQCYKKVGLEATVRFLDDLKDLGFIQATKAAISMGLKDVRIPDIKSHILKDAYDKVAIVKKQYDDGIITEGERHSKTISIWTEVSEQLSDALYVEISKQTRSKHNPLFLMIDSGARGNKSQLKQLGALRGLMAKPNGAIIESPITSNFREGLTVLEYSISSHGARKGLADTALKTADSGYLTRRLVDVAQDVIITEKDCGTLNHIEISAIGQGSEELLPLKDRIYGRTVAEDVYQPGDKSRLLAQSGDVLNSVQAEAIDDAGIETIKIRSTLTCESPRGVCAKCYGLNLANGRLIGMGEAVGIIAAQSIGEPGTQLTMRTFHLGGIAATSSTPEIITNSDGILVYMDLRVVLGQEGHNLVLNKKGALHVVGDEGRTLNEYKKLLSTKSIESLEVFPVELGVKILVADGTPVSQGQRIGEVELHNIPIICDKPGFIKYEDLVEGISTEKVVNKNTGLVELIVKQHRGELHPQIAIYDDADLSELVGTYAIPSGAIISVEEGQRVDPGMLLARLPRGAIKTKDITGGLPRVAELVEARKPEDAADIAKIDGVVDFKGIQKNKRILVVCDEMTGMEEEHLIPLTKHLIVQRGDSVIKGQQLTDGLVVPHEILEICGVRELQKYLVNEVQEVYRLQGVDINDKHIEIIVRQMLQKVRITDPGDTTLLFGEDVNKKEFYEENRRTEEDGGKPAQAVPVLLGITKASLGTESFISAASFQDTTRVLTDAACCSKTDYLLGFKENVIMGHMIPGGTGFETHKRIKQYLEKEQEDLVFDFVSETECVC

SEQ ID NO: 85 - protein, 339 aa, Chlamydia pneumoniae
  CPn0083
RCLEINSDAKVPMSNQFDQLKKLSTIVCDSGDPELVKASGSQDATTNPSLILKVAQEPKFQELLNEAVVWGIRQNGDDLQTLSFILDKIQVNFALEIIKNIPGRISLEIDARLSFNVEAMVQRAVFLSQLFEAMGGDKKRLLVKIPGTWEGIRAVEFLEAKGIACNVTLIFNLVQAIAAAKAKATLISPFVGRIYDWWIAAYGDEGYSIDADPGVASVSNIYAYYKKFGIPTQIMAASFRTKEQVLALAGCDLLTISPKLLDELKKSQHPVKKELDPAEAKKLDVQPIELTESFFRFLMNEDAMATEKLAEGIRIFAGDTQILETAITEFIKQIAAEGA

SEQ ID NO: 86 - protein, 132 aa, Chlamydia pneumoniae
  CPn0084
SEMKNKMDYKSQLVFSCPCCCKGNVCFSVFNLDVILTCNVCSSTYTFDSVIRNEIRQFVALCKRIHDANSILGNATVSVSVEDNQMDIPFQLLFSRFPVVLNLSLDGKKIAIRFLFDALNTSILHQESDLIS

SEQ ID NO: 87 - protein, 249 aa, Chlamydia pneumoniae
  CPn0085
FSMKFFILFILIVAQFPAFSAQPRTQVSASHSKQAKARRTSRIRSSAATNASVSRYKTRAAARKKIGKFEKKPSLSPVQWVRYSGKNYSIQTPSLWQCIDDKTQLPEKLDVLLIGKGKGNLTPTINIAQEITSKSSKEYIEEILAYHKANEMTLESGIFTQIQSPSGEFTIIKTEKNSSWGRVFCLQATTVIDHTAYIFTSTATLDDYAELSFTFLKVVSSFQIRGGKEATSGDAILEKALEALQNENK

SEQ ID NO: 88 - protein, 210 aa, Chlamydia pneumoniae
  CPn0086
NIMANLNADGKLKQICDALRLDTLKPAEDEAAALLHNAKEQAKRIIQEAQEEARKILETAEERAHQKIKQGEVALSQAGKRALEALKQAVENKIFRESLVEWLEHVTTDPEVSTKLIQALVQALEAQGVSGNLTAYIGKHVSPRAVNELLGKAVTTKLRKKSVVVGSFVGGVQLKVEEKNWVLDLSSSALLEIFTRYLQKDFREMIFQGS

SEQ ID NO: 89 - protein, 279 aa, Chlamydia pneumoniae
  CPn0087
SHEKIFSIFKVVVMTQYYFLSSFLPTQLPESVPLFSISDLDDLLYLNLSENDLCNYGLLKRFFDFENFAFFWAGKPIPFSFGEVTQENVERMLSSQQWSDDNDFEDFFKDFLMNHKSSQDRLNHFSDLFREFLSYHQTNSSKFLQDYFRFQQQLRVVLAGFRARVLNMDVSYVLRDEDSSDPVVLEVLMQKDSPNYELPEEFSDLQGVLDDYGLLPHTLNRALALYQFHKLEGFCSDSYFDGNVILARCATYMFAIRNSLASVEKGREIINHIEKAIKW

SEQ ID NO: 90 - protein, 598 aa, Chlamydia pneumoniae
  CPn0088
SYRKGNQMVTVSEQTAQGHVIEAYGNLLRVRFDGYVRQGEVAYVNVDNTWLKAEVIEVADQEVKVQVFEDTQGACRGALVTFSGHLLEAELGPGLLQGIFDGLQNRLEVLAEDSSFLQRGKHVNAISDHNLWNYTPVASVGDTLRRGDLLGTVPEGRFTHKIMVPFSCFQEVTLTWVISEGTYNAHTVVAKARDAQGKECAFTMVQRWPIKQAFIEGEKIPAHKIMDVGLRILDTQIPVLKGGTFCTPGPFGAGKTVLQHHLSKYAAVDIVILCACGERAGEVVEVLQEFPHLIDPHTGKSLMHRTCIICNTSSMPVAARESSIYLGVTIAEYYRQMGLDILLLADSTSRWAQALREISGRLEEIPGEEAFPAYLSSRIAAFYERGGAITTKDGSEGSLTICGAVSPAGGNFEEPVTQSTLAVVGAFCGLSKARADARRYPSIDPLISWSKYLNQVGQILEEKVSGWGGAVKKAAQFLEKGSEIGKRMEVVGEEGVSMEDMEIYLKAELYDFCYLQQNAFDPVDCYCPFERQIELFSLISRIFDAKFVFDSPDDARSFFLELQSKIKTLNGLKFLSEEYHESKEVIVRLLEKTMVQMA

SEQ ID NO: 91 - protein, 452 aa, Chlamydia pneumoniae
  CPn0089
LDCWKKQWYKWRKDMQTIYTKITDIKGNLITVEAEGARLGELATITRSDGRSSYASVLRFDLKKVTLQVFGGTSGLSTGDHVTFLGRPMEVTFGSSLLGRRLNGIGKPIDNEGECFGEPIEIATPTFNPVCRIVPRSMVRTNIPMIDVFNCLVKSQKIPIFSSSGEHHNALLMRIAAQTDADIVVIGGMGLTFVDYSFFVEESKKLGFADKCVMFIHKAVDAPVECVLVPDMALACAEKFAVEEKKNVLVLLTDMTAFADALKEISITMDQIPANRGYPGSLYSDLALRYEKAVEIADGGSITLITVTTMPSDDITHPVPDNTGYITEGQFYLRNNRIDPFGSLSRLKQLVIGKVTREDHGDLANALIRLYADSRKATERMAMGFKLSNWDKKLLAFSELFETRLMSLEVNIPLEEALDIGWKILAQSFTSEEVGIKAQLINKYWPKACLSK

SEQ ID NO: 92 - protein, 214 aa, Chlamydia pneumoniae
  CPn0090
VLAKSMSVQVKLTKNSFRLEKQKLARLQTYLPTLKLKKALLQAEVQNAVKDAAECDKDYVQAYERIYAFAELFSIPLCTDCVEKSFEIQSIDNDFENIAGVEVPIVREVTLFPASYSLLGTPIWLDTMLSASKELVVKKVMAEVSKERLKILEEELRAVSIRVNLFEKKLIPETTKILKKIAVFLSDRSITDVGQVKMAKKKIELRKARGDECV

SEQ ID NO: 93 - protein, 660 aa, Chlamydia pneumoniae
  CPn0091
VRLNIHKYLFIGRNKADFFSASRELGVVEFISKKCFITTEQGHRFVECLKVFDHLEAEYSLEALEFVKDESVSVEDIVSEVLTLNKEIKGLLETVKALRKEIVRVKPLGAFSSSEIAELSRKTGISLRFFYRTHKDNEDLEEDSPNVFYLSTAYNFDYYLVLGVVDLPRDRYTEIEAPRSVNELQVDLANLQREIRNRSDRLCDLYAYRREVLRGLCNYDNEQRLHQAKECCEDLFDGKVFAVAGWVIVDRIKELQSLCNRYQIYMERVPVDPDETIPTYLENKGVGMMGEDLVQIYDTPAYSDKDPSTWVFFAFVLFFSMIVNDAGYGLLFLMSSLLFSWKFRRKMKFSKHLSRMLKMTAILGLGCICWGTTTTSFFGMSFSKTSVFREYSMTHVLALKKAEYYLQMRPKAYKELTNEYPSLKAIRDPKAFLLATEIGSAGIESRYVVYDKFIDNILMELALFIGVVHLSLGMLRYLRYRYSGIGWILFMVSAYLYVPIYLGTVSLIHYLFHVPYELGGQIGYYGMFGGIGLAVVLAMIQRSWRGVEEIISVIQVFSDVLSYLRIYALGLAGAMMGATFNQMGARLPMLLGSIVILLGHSVNIILSIMGGVIHGLRLNFIEWYHYSFDGGGRPLRPLRKIVCSEDAEASGIHLDNNSIV

SEQ ID NO: 94 - protein, 151 aa, Chlamydia pneumoniae
  CPn0092
RYLKGAHEVSMIDMSVVGPALVLGLAMIGSAIGCGMAGVASHAVMSRIDEGHGKLIGMSAMPSSQSIYGFILMLLMQAAIKNGTLSPVGGIAIGLSVGAALLVSSVMQGKCCVSGIQAYARSSSIYGKCYAAIGIVESFSLFAVVFALLLL

SEQ ID NO: 95 - protein, 192 aa, Chlamydia pneumoniae
  CPn0093
CKASVVSAEFKLMLDLRQYMGSVMQRLGLSNLFHCLLLFLRYYYSKLVFGLTVLLAAISVICLLGCSEPSLSSFTEYVGPEYSAAAQLSIEQSCHDEVYGQQVVVTWSLPSRMRKCLPVTLYLWVYYGNGKVEKLTYEVNQSAGYRVYCLKGLEYKELQGIISYRVALCSGNQEIVSRRHHLWMEVISLDSP

SEQ ID NO: 96 - protein, 956 aa, Chlamydia pneumoniae
  CPn0094
VYRVFLSRDHKFGLRIMTTEDFPKAYNFQDTEPELYVFWEKNGMFKAEASSDKPPYSVIMPPPNVTGVLHMGHALVNTLQDVLVRYKRMSGFEVCWIPGTDHAGIATQAVVERHLQASEGKRRTDYSREDFLKHIWAWKEKSEKVVLSQLRQLGCSCDWDRKRFTMEPLANRAVKKAFKTLFENGYIYRGYYLVNWDPVLQTALADDEVEYEEKDGWLYYIRYRMVGSQESIVVATTRPETSLGDTGIAVSPNDERYASWIGASVEVPFVNRQIPIIGDASVDPTFGTGAVKVTPAHDKDDYLMGTNHHLPMINILTPSGGINENGGPFAGMAKEKAREEILIALEEQGLFVRKEPYKLRVGVSYRSGAVIEPYLSKQWFVSVSEFRGALREFVESQDIKIFPKDFVKNYLSWVNHLRDWCISRQLWWGHRIPVWYHKNDDERVLCYDGEGIPEEVAQDPDSWYQDPDVLDTWFSSGLWPLTCLGWPDENSPDLKKFYPTALLVTGHDILFFWVTRMVLLCSSMSGEKPFSEVFLHGLIFGKSYKRYNDFGEWSYISGKEKLAYDMGEALPDGVVAKWEKLSKSKGNVIDPLEMIATYGTDAVRLTLCSCANRGEQIDLDYRLFEEYKHFANKVWNGARFIFGHISDLQGKDLLAGIDEDSLGLEDFYILDGFNQLIHQLEEAYATYAFDKVATLAYEFFRNDLCSTYIEIIKPTLFGKQGNEASQSTKRTLLAVLLINVLGVLHPVAPFITESLFLRIQDTLGALPEGDGDAFTGHALRMLRSRACMEAPYPKAFDVKIPQDLRESFTLAQRLVYTIRNIRGEMQLDPRLHLKAFVVCSDTTEIQSCIPILQALGGLESIQLLDKEPEKGLYSFGVVDTIRLGIFVPEEHLLKEKGRLEKERVRLERAVENLERLLGDESFCQKANPNLVVAKQEALKNNRIELQGILDKLASFA

SEQ ID NO: 97 - protein, 945 aa, Chlamydia pneumoniae
  CPn0095
ACIVCLDREDQRSLERYDIVRIIGKGGMGEVYLAYDPVCSRKVALKKIREDLAENPLLKRRFLREARIAADLIHPGVVPVYTIYSEKDPVYYTMPYIEGYTLKTLLKSVWQKESLSKELAEKTSVGAFLSIFHKICCTIEYVHSRGILHRDLKPDNILLGLFSEAVILDWGAAVACGEEEDLLDIDVSKEEVLSSRMTIPGRIVGTPDYMAPERLLGHPASKSTDIYALGVVLYQMLTLSFPYRRKKGKKIVLDGQRIPSPQEVAPYREIPPFLSAVVMRMLAVDPQERYSSVTELKEDIESHLKGSPKWTLTTALPPKKSSSWKLNEPILLSKYFPMLEVSPASWYSLAISNIESFSEMRLEYTLSKKGLNEGFGILLPTSENALGGDFYQGYGFWLHIKERTLSVSLVKNSLEIQRCSQDLESDKETFLIALEQHNHSLSLFVDGTTWLIHMNYLPSRSGRVAIIVRDMEDILEDIGIFESSGSLRVSCLAVPDAFLAEKLYDRALVLYRRIAESFPGRKEGYEARFRAGITVLEKASTDNNEQEFALAIEEFSKLHDGVAAPLEYLGKALVYQRLQEYNEEIKSLLLALKRYSQHPEIFRLKDHVVYRLHESFYKRDRLALVFMILVLEIAPQAITPGQEEKILVWLKDKSRATLFCLLDPTVLELRSSKMELFLSYWSGFIPHLNSLFHRAWDQSDVRALIEIFYVACDLHKWQFLSSCIDIFKESLEDQKATEEIVEFSFEDLGAFLFAIQSIFNKEDAEKIFVSNDQLSPILLVYIFDLFANRALLESQGEAIFQALDLIRSKVPENFYHDYLRNHEIRAHLWCRNEKALSTIFENYTEKQLKDEQHELFVLYGCYLALIQGAEAAKQHFDVCREDRIFPASLLARNYNRLGLPKDALSYQERRLLLRQKFLYFHCLGNHDERDLCQTMYHLLTEEFQL

SEQ ID NO: 98 - protein, 1837 aa, Chlamydia pneumoniae
  CPn0096
ETFLSILREFFMKSLPVYVSGIKVRNLKNVSIHFNSEEIVLLTGVSGSGKSSIAFDTLYAAGRKRYISTLPTFFATTITTLPNPKVEEIHGLSPTIAIKQNHFSHYSHATVGSTTELFSHLALLFTLEGQARDPKTKEVLDLYSKEKVLSTIMELSEGVQISILAPLLRKDIAAIHEYAQQGFTKVRCNGTIHPIYSFLTSGIPEDCSVDIVIDTLIKSENNIARLKVSLFTALEFGEGHCSVLSDEELMTFSTKQQIDDVTYTPLTQQLFSPHALESRCSLCQGSGIFISIDNPLLIDENLSIKENCCSFAGNCSSYLYHTIYQALADALNFNLETPWKDLSPEIQNIFLRGKNNLVLPVRLFDQTLGKKNLTYKVWRGVLNDIGDKVRYTTKPSRYLSKGMSAHSCSLCKGTGLGDYASVATWEGKTFTEFQQMSLNNWHVFFSKVKSPSLSIQEILQGLKQRLSFLIDLGLGYLTPNRALATLSGGEQERTAIAKHLGGELFGITYILDEPSIGLHPQDTEKLIGVIKKLRDQGNTVILVEHEERMISLADRIIDIGPGAGIFGGEVLFNGKPEDFLMNSSSLTAKYLRQELTIPIPESREAPTSWLLLTEATIHNLKNLSIRLPLARLIGVTGVSGSGKSSLINNTLVPAIESFLKQENPKNLHFEWGCIGRLIHITRDLPGRSQRSIPLTYIKAFDDIRELFASQPRSLRQGLTKAHFSFNQPQGACIQCQGLGTMTISDDDTPIPCSECQGKRYHSEVLEILYEGKNIADILDMTAYEAEKFFISHPKIHEKIHALCSLRLDYLPLGRPLSTLSGGEIQRLKLAHELLFASPKQTLYVLDEPTTGLHTHDIQALIEVLLSLTYLGHTVLVIEHNMHVVKVCDYVLELGPEGGDLGGYLLASCTPKDLIQLNTPTAKALAPYIEGSLDIPVVKSEPPSSPKSCDILIKDAYQNNLKHIDLALPRNSLIAIAGPGASGKHSLVFDILYASGNIAYAELFPPYIRQGLLKETPLPSVGEVKGLSPVISVRKCSSSNRSYHTIASALGLSNGLEKLFAILGEPFSPLTEEKLSKTTPQTIIDSLLKSYKDDYVTITSPIPLGSDLEIFLQEKQKEGFIKLYSEGNLYDLDERLPLNLIEPAIVIQHTKVSPKNSSSLLSAISVAFSLSSEIWIYISQKKQRKLSYSLGWKDKKGRLYPEITHQLLSSDHPEGRCLTCGGRGEILKISLEEHKEKIAHYTPLEFFSLFFPKSYMKPVQKLLKDENASQPLKLLTTKEFLNFCRGSSEFPGMNALLMEQLDTESDSPLIKPLLALTSCPACKGSGLNDYANYVRINNTSLLDIYQEDATFLESFLNTIGTDDTRSIIQDLMNRLTFISKVGLSYITLGQRQDTLSDGENYRLHLAKKISINLTNIVYLFEEPLSGLHPQDLPTIVQLLKELVANNNTVIATDRSCSLIPHADHAIFLGPGSGPQGGFLMDSDTEVCPSVDLHANVPQTEVCPKAPLSISKANHTRGSDRTLKVNLSIHHIQNLKVSAPLHALVAIGGVSGSGKTSLLLEGFKKQAELLIAKGTTTFSDLVVIDSHPIASSQRSDISTYFDIAPSLRAFYASLTQAKALNISSTMFSTNTKQGQCSDCQGLGYQWIDRAFYALEKRPCPTCSGFRIQPLAQEVLYEGKHFGELLHTPIETVALRFPFIKKIQKPLKALLDIGLGYLPIGQKLSSLSVSEKTALKTAYFLYQTPETPTLFLIDELFSSLDPIKKQHLPEKLRSLINSGHSVIYIDHDVKLLKSADYLIEIGPGSGKQGGKLLFSGSPKDIYASKDSLLKKYICNEELDS

SEQ ID NO: 99 - protein, 486 aa, Chlamydia pneumoniae
  CPn0097
DSMITRTKIICTIGPATNSPEMLAKLLDAGMNVARLNFSHGSHETHGQAIGFLKELREQKRVPLAIMLDTKGPEIRLGNIPQPISVSQGQKLRLVSSDIDGSAEGGVSLYPKGIFPFVPEGADVLIDDGYIHAVVVSSEADSLELEFMNSGLLKSHKSLSIRGVDVALPFMTEKDIADLKFGVEQNMDVVAASFVRYGEDIETMRKCLADLGNPKMPIIAKIENRLGVENFSKIAKLADGIMIARGDLGIELSVVEVPNLQKMMAKVSRETGHFCVTATQMLESMIRNVLPTRAEVSDIANAIYDGSSAVMLSGETASGAHPVAAVKIMRSVILETEKNLSHDSFLKLDDSNSALQVSPYLSAIGLAGIQIAERADAKALIVYTESGSSPMFLSKYRPKFPIIAVTPSTSVYYRLALEWGVYPMLTQESDRAVWRHQACIYGIEQGILSNYDRILVLSRGACMEETNNLTLTIVNDILTGSEFPET

SEQ ID NO: 100 - protein, 468 aa, Chlamydia pneumoniae
  CPn0098
LVGKKFHQIKRTILEAPLYYLVSGIIALCRHTPRSFLTGLGKGFGFLAFYIISDYRKTALTNLALAFPEKTFDERYKIARQSLQHLIITLLELLAIEQLVGNIDKLITIVTSSRNPKGFSSEEVISNEDLEETFKNLQEKQGLILFCGHQANWELPFLYITKNYPGIAFAKAIKNQRLSKKIFALREVFKGKIVPPKNGIQQGIEALNQGKLVGIVGDQALLMSSYTYPLFGSPAFTTTSPALLAYKTGFPVIAVNVSRQAKGFEVIPSAKLYANKSLPMKESVAILMDQMMGFLEKGIASQPEQWMWIHKRWKRKISNVIKKKYRYSHILVFVDQVSSHFSFLKALAECFSGTTLHLALGNADHLEELQEQFPEYSLIQLRNDQDILALPNCYPAIFDLTNNLQHLYKHFRKTGSCAVYSKRFLEKSLDHPQAPLKNSLRIFYSKNLKDKERKNFKVKSKGPRLTVE

SEQ ID NO: 101 - protein, 113 aa, Chlamydia pneumoniae
  CPn0099
YYCASYYLKISRFAAKHAPERNMLNSIVTTRTRTAATLLIPKVIPEAPSTPVQIKMISIKETIAVRAKSPADTVATFALDSELSEQQQTVLIAASKPRPKQSIKHIKFPLTKF

SEQ ID NO: 102 - protein, 434 aa, Chlamydia pneumoniae
  CPn0100
RTQKKTFILLDLETMIKFLSQLFIRHWPRKVVSLGFAIIIWILVGQSVTITRTLTNVPVRIVDLHPDQTVLGLQKSGFLNKKVSLTITGNKNTVQDLRPSNLEVVISAANHTESWIATIDKHNLVSVDHEINIRKDIHSVDANDIFVRLTQYVTEDILLTITKPIGSPPKGYEYLDVWPKYLNQKVSGPKEYINALKEQGLELTFNLNKISFEELERNRIAQGSHDEIIFPIPKEWKKILIPFENTFMDLNDPQADFLRLLFLKRECIPLNLNLPVFLFFPVTFIQTMNPLEYSLDPVPPIILNHGIHQINIPLYVKDVSRQFLDVVKNNMVLTIVMPSPQDPSSINWAIEFLDEKTLENTFLQTIIAQEHGILHDIALIDEAGIRHRFREYLRKLALFTADGEPLNLIAEIKNNKVVIQTKTKETTKLYKKEW

SEQ ID NO: 103 - protein, 282 aa, Chlamydia pneumoniae
  CPn0101
PSTLCNFSQYTTQGPSKTMPFDITYYTTPLLEIILIWVMLNYLLKFFWGTRAMDVVFGLLAFLFLFVLADKLHLPIIRRLMLHVVNIAAIVVFIIFQPEIRLALSRIRFHGKKFFIDTQEQFVEQLAASIYQLSERQIGALVVLENKDSFDEYLSFSSVKINATFSEELLETIFEPSSPLHDGAVILRGDILAYARVVLPLAHDTTQLSRSMGTRHRAALGASQRSDALIITVSEENGSVSLSRDGLLTRGVKIDRFKAVLRSILSPKEHKRKPLFSWIWKR

SEQ ID NO: 104 - protein, 456 aa, Chlamydia pneumoniae
  CPn0102
FYIQFWKFMDALILSRIQFGLFITFHYLFVPLSMGLSMMLVIMEGLYLVTKKQIYKQMTWFWVGIFALTFVLGVVTGIMQIFSFGSNWANFSEYTGNIFGTLLGSEGVFAFFLESGFLGILLFGRHKVSKKMHFFSTCMVALGAHMSAFWIICANSWMQTPSGYEMVMHKGKLIPALTSFWGVVFSPTTIDRFIHAVLGTWLSGVFLVISVSAYYLWKKRHHEFAKQGMKIGTICAVIVLVLQLWSADVTARGVAKNQPAKLAAFEGIFKTEEYTPIWAFGYVDMEKERVIGLPIPGALSFLVHRNIKTPVTGLDQIPRDEWPNVQAVFQLYHLMIMLWGVMVALTLISWSAYKGWRWALKPFFLVILTFSVLLPEICNECGWCAAEMGRQPWVVQGLLKTKDAVSPIVQANQIVQSLVIFSLVFIALLTLFITVLCKKIKHGPEEENDLTEFEVK

SEQ ID NO: 105 - protein, 349 aa, Chlamydia pneumoniae
  CPn0103
NRGIFMELSLTSLLPLAWYVILGVAVFAYSFGDGFDLGLGAVYLKAKEDKERRILLNSIGPVWDGNEVWLVIIVGGLFAGFPACYATLLSIFYMPIWTLVLLYIFRGCSLEFRSKSESVSWKIFWDIIFICSGTAISFFLGTIVGNLILGLPLSPDTSYASLSWILFFRPYAALCGAVVASAFAIHGSCFALMKTSDSLNARIAQQFPYILSSFLVFYVLFLGASLISIPKRFDAFPTYPLLILLIALTSCCCVAAKTSVSKKRYGYAFIYSTLNLLSLILSAATLTFPNILLSTVDPQYSYTIYNSAVETKTLKSLLIIVLIGLPFIITYTCYIYRVFRGKTNFPSIY

SEQ ID NO: 106 - protein, 403 aa, Chlamydia pneumoniae
  CPn0104
EKSMRMLQISMLLLALGTAINSPAIYAADSQSVSFPEQLPSSFTGEIKGNHVRMRLAPHTDGTIIREFSKGDLVAVIGESKDYYVISAPPGITGYVFRSFVLDNVVEGEQVNVRLEPSTSAPVLVRLSRGTQIQPASQEPHGKWLEVVLPSQCVFYVAKNFVANKGPIELYTQREGQKKIAMDLINSALNFAHIELEKSLNEIDLEAIYKKINLVQSEEFKDVPGIQGLIQKALEEIQDAYLSKSLESQNTSIASSQCSTPKVSSSEVTTSLLSRHIRKQTALKTAPLTQGRENLEYSLFRIWASMQQGNDHSEALTQEAFYRAEQKKKQVLAGVLEVYPHVVKNNPGDYLLKAQENTIAFLYGTSINLEQWLGKRVTVECLPRPNNHFAFPAYYVVGIKEAS

SEQ ID NO: 107 - protein, 285 aa, Chlamydia pneumoniae
  CPn0105
YVPFRKFSNQNPMLLIYCKKKEIHLQWPQTAKIRFTPKIAMKVKINDQLICIPPFISARWSQIAFIESQEGENKDQGTLRLHLIDGKIISIPNLDQSIIDIAFQEHLLYLETSQSGKEDSRDDDKLGVGVLMNVLQQITKGNDIQVLPKNLISPLFSGTNPIEAILQHTPEHKDHPDAPTDVLEKMADVIRVLSGNNATLLPRPEPHCNCMHCQIGRVMNEEDTLAVSDKDLTFRTWDIMQSGDKLYIVTNPLNPSDQFSVYLGPPIGCTCGEPNCEHIKAVLYT

SEQ ID NO: 108 - protein, 434 aa, Chlamydia pneumoniae
  CPn0106
EKVRTQMKKTMVIDTSVFIYDPEALFSFENTRIIIPFPVIEELEAFGKFRDESAKNASRALSNIRLLLENAKTKVTDGVLLPSGSELRIEVAPLSNDDRRGKLLTLELLKIIAKREPMVFVTKSLGRRVRAEALQIESRDYESKRFSFRSLYRGFRELQVSQEDIENFYKNGYLDLPLDVVSSPNEYFFMSAGENHFALGRYYVSEGKIIALKAMDKSVWGIKPLNTEQRCALDLLLRDDVKLVTLIGQAGSGKTILALAAAMHKVFDKETYNKVLVSRPIVPMGRDIGFLPGLKEDKLMHWMQPIYDNMEVLFSINQMGNSSEALQALMDAKKLEMEALTYIRGRSLPKAFIIIDEAQNLTPHEIKTIISRAGKGTKIVLTGDPTQIDSLYFDENSNGLTYLVGKFHHLALYGHMFMTRTERSELAAAAATIL

SEQ ID NO: 109 - protein, 310 aa, Chlamydia pneumoniae
  CPn0107
KKSPPPVTPKEIPTQPKPPIPQRPEVSPTPTDHIVPGSIEASPILGKKPSPDSMVSPLSLFHKMLLENWTPVEEPFPWPPAEKNQKIFAWALNQSKLIFVSTSGNIAQPRLVTDSMSMMIVNAANRTMSRDGAGTNQVLSAAVSVDSWGLSQRPLNPERQGTPLNEGECRAGMWRNADGSNHTGKQGKPHYLAQLLGPKAVDHHNKSQAAFDRCKNAYLNCFSLAQTLGVTFLQIPLISSGIYAPPENRKKPNSEENKVRMRWIHAVKCALVAAMQEFGNEPGNTDRRMLIVLTDLKTPAITDPKKKSHL

SEQ ID NO: 110 - protein, 195 aa, Chlamydia pneumoniae
  CPn0108
KNLFHYKAILMSIFNEEVFIISHRHTPLGQTSTALRNTPLVNPLHRTNLQRIASYIPIFSTFIGIKTLKGISSLQYSMVLMTGNFSSVCKTLPCPEIYEELPKVRKEAWLEIFGIKALYYLVLGVIKIIKLIVRYLCPCCRPPEPREPQNPLTPTPLDMGQQIDAIFSTPTSPTGFKDPFLDDLLQEDKKKAPHL

SEQ ID NO: 111 - protein, 1046 aa, Chlamydia pneumoniae
  CPn0109
RQKMTADEVGKNSFAKKEEQVLKFWKDNQIFEKSLQNRQGKTLYSFYDGPPFATGLPHYGHLLASTIKDVVGRYATMDGYYVPRRFGWDCHGVPVEYEVEKSLSLTAPGAIEDFGIASFNEECRKIVFRYVHEWEYYINRIGRWVDFSSTWKTMDASFMESVWWVFQSLYNQGLVYEGTKVVPFSTALGTPLSNFEASQNYKEVDDPSLVVRMPLQNDSASLLVWTTTPWTLPSNMAIAVGETLVYVRIQDKKSGEQWILSQGCVSRWFSNPEEFVILESFSGKDLVGRTYEPPFTFFQSKREEGAFRVIAASFVEESEGTGVVHMAPAFGEGDFLVCKENHVPLVCPVDAHGSFTEEIPQYQGQYIKHADKEIIKFLKKEGRIFYHGTVKHRYPFCWRTDTPLIYKAVNSWFVAVEKIKDKMLRANSSIHWVPEHIQEGRFGKWLEGARDWAISRNRYWGTPIPIWKSADGEILVVGSIRELEELTGTQITDIHRHFIDDLNIVKDGKPFHRIPYVFDCWFDSGAMPYAQNHYPFENQKETEEAFPADFIAEGLDQTRGWFYTLTVISAILFDRPAFRNAIVNGIILAEDGNKMSKRLNNYPSPKYVLDTYGADALRLYLLHSVVVKAEDLRFSDKGIEGVLKQILLPLTNVLSFFNTYAELYGFDPKSQDIEPAYTEIDQWILSNLYSVVGKVRESMSQYHLNFAVEPFVTFIDDLTNWYIRRCRRRFWEAEDTPDRRAAFSTLYEVLTVFCKVIAPFVPFLAEDIYQKLKLEKEPESVHLCDFPQVEMDKILPDLEKRMHDIREIVGLGHSLRKEHKLKVRQPLANFYVVGSKDRLSLLKTFEGLIAEELNVKNVIFYEEAPSFIYTTVKPNFRMLGKKVGSKMKEVQKALSELPNNAIDKLIQEETWVLTIDDREIALDGDDVVICRHTDPGYIARSSALFSVILDCQLREPLIVEGIARELVNKINTMRRNQQLHVSDRIALRIKTTEAVHRAFLDYENYICEETLIIAYDFTQDSDFQGENWDINGHATQIEITVSSIDS

SEQ ID NO: 112 - protein, 643 aa, Chlamydia pneumoniae
  CPn0110
LSYPSIFMKQHYSLNKSRHILRSTYKLLKSKKLAHSPADKKQLQELLEQLEEAIFEHDQETASDLAQQALAFSNRYPNSFGRKTYELIKALLFAGVVAFLVRQFWFELYEVPTGSMRPTILEQDRILVSKTTFGLHCPFAKKPLAFNPESVTRGGLVVFTVGDLPIPDADTKYFGLIPGKKRYIKRCMGRPGDFLYFYGGKIYGLDDAGKRIEFPSVHGLENLYHVPYISFDGTTSSHTEGQKTIIDFKQFNQSYGRLIFPQTSMYGQFFDHKEWHQDEPNKLKDPHLSPVSYADLFGMGNYAMVRILTEHQARTSHLLPNPGSPTKVYLEICHTANLSYPKPLLRHYEHQLSPAIQPMKTLLPLRKEHLHLIRNNLTTSRFIVAQGCAYKYHQFKINTSGIAKAYAILLPKVPDGCYEYSKGEAYQIGFGEIRYKLKSSHPLTQLNDKQVIELFNCGINFSSIYNPVNPLQAPLPNRYAFFNQGNLYIMDSPVFIKNDPTLQKFVTSETEKQEGSSETQPYIAFVDKGLPPEDFKEFVEFIHNFGIQVPKGHVLVLGDNYPMSADSREFGFVPMENLLGSPLCTFWPIGRMGRLTGVSAPTTLSGYLVSGIALATGLSLIGYVYYQKRRRLFPKKEEKNHKK

SEQ ID NO: 113 - protein, 276 aa, Chlamydia pneumoniae
  CPn0111
QLQNRYPIMPNDSSTYFERILQKYLMKKQGKTLFLFLFLSFLFSTAFSGLFASQTSSLRTIQENIFLAKTGDYTVLSRGSQRTFVLVKSTTPKTVWIEIIHFPCIAHKERPSLEQASWKTVIHQLESPSQVFVVSLSSEGSQFFSLNTRTKSLEPVGKSTTVPAFLQIFDLPLSPAPANVIKTKGKENKPWSPKVSFEGAPLTSISVNAWQGLWPKDRGPLSETGILMYFTQPDISVFPLWVSIETPKGTSIVRAVDIGHGATSPYVYSLPDSKTQ

SEQ ID NO: 114 - protein, 117 aa, Chlamydia pneumoniae
  CPn0112
DSDFGVVNMKKNTHPEYRQVLFVDSSTGYKFVCGSTYQSEKTEVFEGKEYPVCYVSVSSSSHPFFTGSKKFVDAEGRVDKFLKRYSNVRQPAQQPQPEEDALPAAKGKKKVVTKKKK

SEQ ID NO: 115 - protein, 359 aa, Chlamydia pneumoniae
  CPn0113
GFMKKKVAEYLNRLAEVEIKISNPEIFSNSKEYSALSKEHSYLLELKNAYDKILNLEKVLADDKQALAIEKDPEMVVMLEEGINENKVELEKLNKILESLLVPPDPDDDLNVIMELRAGTGGEEAALFVGDCVRMYHLYASSKGWKYEVLSASESDLKGYKEYVMGISGTGVKRLLQYEAGTHRVQRVPETETQGRVHTSAITIAVLPEPSEEDTELLINEKDLKIDTFRASGAGGQHVNVTDSAVRITHLPTGVVVTCQDERSQHKNKDKAMRILKARIRDAEMQKRHNEASAMRSAQVGSGDRSERIRTYNFSQNRVTDHRIGLTLYNLDKVMEGDLDPITTAMVSHAYHQLLEHGN

SEQ ID NO: 116 - protein, 297 aa, Chlamydia pneumoniae
  CPn0114
VMPTTSYSNMEIKKAIQEGTAYLDYYGVPLSDCEALYILMDLLEVSSRAKLFDLVGISETMLMEYRKRLALRGQRCPTAYLNGAVSFLGLRLRVDSRVLIPRTETELLAEYIINYLLSHSEIQTFYDICCGSGCLGLAIKKSCPHVEVVLSDVCPQAVAVANENAKSNGLDVKILLGDLSAPYTRPADAFVCNPPYLSFNEIIHIDPEVRCYEPWKALVGGSTGLEFYQRIAQELPKIVTSTGVGWLEIGSSQGESIKNIFSKHGIYGRLHQDLSGRDRIFFLEMDGRDPVSSGAYS

SEQ ID NO: 117 - protein, 448 aa, Chlamydia pneumoniae
  CPn0115
MINSLSQKLSSIFSFLVSSRRINEENISESIREVRLALLDADVNYHVVKDFISKVKEKILGEEIWKHVSPGQQFIRCLHEELVAFLSDGREEFTIQKTPSIILLCGLQGAGKTTTAAKLADYVIKNKKAKKVLVVPCDLKRFAAVDQLKILVAQTKAEFYQSQENKPINVVVKALAYAKENGHDFVILDTAGRLNIDNELMEELTAIQKVSQANERLFVMNVAMGQDVLATVQAFDQSLDLTGVILSMTDGDARAGAVFSIKHVLGKPIKFEGCGERIQDLRSFDPQSMAERILGMGDTINFVKEMREYISEEEDAELGKKLVTAAFTYEDYYKQMKAFRRMGPLRKLLGMMPGFNNAKPSQKEIEDSEQQMKRTEAIILSMTPEERKELVELDMSRMKRIASGCGLTLGDVNQFRKQMSQSKKFFKGMSKGKMEQVRKKMSGGNQWR

SEQ ID NO: 118 - protein, 127 aa, Chlamydia pneumoniae
  CPn0116
EKNVRRKSVALKIRLRQQGRRNHVVYRLVLADVESPRDGKYIELLGWYDPHSSINYQLKSERIFYWLERGAQLSSKAEALVKQGAPGVYSALLSKQEARKLVVRKKRRAYRQRRSTQREEAAKDATK

SEQ ID NO: 119 - protein, 363 aa, Chlamydia pneumoniae
  CPn0117
TGMKIDILSLFPGYFDGPLQTSILGRAIKQRLLDVQLTNLRDFGLGKWKQVDDTPFSGGGMLLMAEPVTSAIRSVRKENSKVIYLSPQGALLTAEKSRELAAASHLILLCGHYEGIDERAIESEVDEEISIGDYVLTNGGIAALVLIDAVSRFIPGVLGNQESAERDSLENGLLEGPQYTRPREFEGKEVPEVLLQGDHKAISQWRLEQSERRTYERRPDLYLNYLYKRSIDHKFDEETTTNRDHFKCDKISVVLEVNKLKRAKNFYCKVFGLDAMSCENKFCLPHEGKTIFWLREVQAEKKNIVTLSLSLDCACEEDFCYLLRRWELFGGKLLEKQADEHAVWALAQDLDGHAWIFSWHRMK

SEQ ID NO: 120 - protein, 130 aa, Chlamydia pneumoniae
  CPn0118
KKENFRWYIMVNLLKELEQEQCRNDLPEFHVGDTIRLATKISEGGKERVQVFQGTVMARRGGGSGETVSLHRVAYGEGMEKSFLLNSPRIVSIEIVKRGKVARARLYYLRGKTGKAAKVKEFVGPRSSKK

SEQ ID NO: 121 - protein, 215 aa, Chlamydia pneumoniae
  CPn0119
LMNTSISEIQRFLSMIAFEKELVSEDFSVVAGIDEAGRGPLAGPVVASACILPKGKVFPGVNDSKKLSPKQRAQVRDALMQDPEVCFGIGVISVERIDQVNILEATKEAMLQAISSLPISPDILLVDGLYLPHDIPCKKIIQGDAKSASIAAASILAKEHRDDLMLQLHRLYPEYGFDRHKGYGTSLHVEAIRRYGPSPCHRKSFSPIKQMCAIV

SEQ ID NO: 122 - protein, 218 aa, Chlamydia pneumoniae
  CPn0120
EELFSNKANVCYCMNKILVDSPFSPDHQKCCPKLFTISAPAGVGKTTLVRMLEQEFSSAFAETISVTTRKPREGEVPGKDYHFVSHEEFQRLLDRQALLEWVFLFGECYGTSMLEIERIWSLGKHAVAVIDIQGALFIRSRMPSVSIFIAPPSQEELERRLASRGSEEGSQRKERLEHSLIELAAANQFDYVIINDDLNQAYRVLKSIFIAEEHRNIL

SEQ ID NO: 123 - protein, 100 aa, Chlamydia pneumoniae
  CPn0121
EHIMIKKDRFTNEKLNKLFDSPFSLVNYAIKQAKIKIAKGDVRSSNVAIETLVLLDREGIQPEFTEEIVVTASPTVERKRSEHTNSRKKDPSAYTWSDVK

SEQ ID NO: 124 - protein, 554 aa, Chlamydia pneumoniae
  CPn0122
CKVMPQKVLITSALPYANGPLHFGHIAGVYLPADVYARFRRLLGDDVLYICGSDEFGIAITLNADREGLGYQEYVDMYHKLHKDTFEKLGFALDFFSRTTNPFHAELVQDFYSQLKASGLIENRISEQLYSEQEQRFLADRYVEGTCPRCGFDHARGDECQSCGADYEAIDLIGPKSKISGVELVKKETEHSYFLLDRMKDALLSFIQGCYLPDHVRKFVVDYIEHVRSRAITRDLSWGIPVPDFPGKVFYVWFDAPIGYISGTMEWAASQGNPDEWKRFWLEDGVEYVQFIGKDNLPFHSVVFPAMELGQKLDYKKVDALVVSEFYLLEGRQFSKSEGNYVDMDKFLSSYSLDKLRYVLAATAPETSDSEFTFLDFKTRCNSELVGKFGNFINRVLAFAEKNHYDKLSYHSVVLEDSDRAFLEEARQLVRDAEKCYREYSLRKATSVIMSLAALGNVYFNQQAPWKLLKEGTRERVEAILFCACYCQKLLALISYPIIPESAVAIWEMISPKSLENCNLDTMYARDLWKEEILDVINEEFHLKSPRLLFTTVE

SEQ ID NO: 125 - protein, 734 aa, Chlamydia pneumoniae
  CPn0123
NSMEKICGYLEQILVENKDSGDITAYIKIPNKTTPILIKGKLPQPLELGSPIQIYGVWSHSPSNTKYFQIHSYDSPLLYEYRGVFHYLTSKLIKGIGPKIAEKIIEKFQEKTCYVLDITPERLSEVSGISETRCVSICKQLCEQKILRKTLLFLQEYNIPIHYGVRIFKKYQEKSIEKICEDPFLLAREMEGIGFKTADFIAMKLGVPRNSESRLCAGIQHSLEELQEEGHTCYPIELLIDVVAKLLNQDVFDTPITLEEIDTQILNMQKRKLLHIQDISGTLHVWTRYLHLAEKTIVSDLKRILFSSRRIRSIDGEKAIAWVEENLSIDLAEQQREAIKACFSEKLLIITGGPGTGKSTITQAILKIFEQVTHKIILAAPTGKAAKRMTEITQKHSVTIHALLQYDFKTKSFRKNHDNPIDCDLIIVDESGMMDTHLLHHFLKALPDYTTLVFIGDIHQLPSVGPGNILKDLITSNKMTVIRLNKIFRQVHDSGIVTNAHRVNEGELPILYSETGRRDFLFFQKDDQEEALNHIIHLVTKFVPQKYHIYPQDIQVLAPMKKGTLGIYNLNKALKHALNPKKANLHGRFQSYAVGDKVMQIRNNYNKEVFNGDIGYVSTINFEDKAVVVRMEGKHVGYSFSELDDLVLAYATSVHKYQGSESPCIIIPIHTSHFMMLYRNLLYTAITRGKKLVILVGTKKAIAIATRNNRVQHRCTGLAEVLKELDTKKNYADL

SEQ ID NO: 126 - protein, 498 aa, Chlamydia pneumoniae
  CPn0124
IRSKQRTVAITLLVLGILLIASGIIFLAVAIPGLSSAVALGLGCGMTALGTVLLITGLVLLIRSEKLALEQVEIKQARTRVNNELDQLSQYVFYTENVLDNLKRWSYRDLGFVRQAQEEVTNLEQDIEEIFLTLRDIRNALDNEEFFMTHAKQCLAQVGESLFQDASIDEFINLAHLSEIRQHLDINDPRWSMITKKVKGTVVRFIYVSTMYKQIKSNFEKSDFGQLRKMLLNNYKTIEEVLYQSFQKGYNRAALLSEKTRIIHTSSLLHWEKDEDKHLNIKNECASRLENFKKFRTLFLGLSEEDVIDFTGASGWDCSKLPRKEVPLDGGKKKLRFKRTFADEQVGDWDRTTSLEHMTPQEEDPLDRLMDQVEQEATSVLKDQDRYWKEIETSEAKFRSLPREDDFEKQSQIDSYIRDLDDHLSVWANQLSAAEDALIEVTDVQEHGNREMLKNIQQGLELIEDAVKATLPRVDFIQELLEKEELPLVAARMSLENS

SEQ ID NO: 127 - protein, 178 aa, Chlamydia pneumoniae
  CPn0125
KISSCAEIMSEVKPLFLKNDSFDLATQRFQNLINMLQEQAEIYNEYEEKNARVQNEIKEQKDFVKRCIEDFEARGLGVLKEELASLTRDFHDKAKAETSMLIECPCIGFYYSIHQEEQRQRQERLQKMAERYRDCKQVLEAVQVEQKDMISSRVVVDDSYFEEEKEEQKVDNRKKEQD

SEQ ID NO: 128 - protein, 760 aa, Chlamydia pneumoniae
  CPn0126
LLVFSYYCMGLFFFSGAISSCGLLVSLGVGLGLSVLGVLLLLLAGLLLFKIQSMLREVPKAPDLLDLEDASERLRVKASRSLASLPKEISQLESYIRSAANDLNTIKTWPHKDQRLVETVSRKLERLAAAQNYMISELCEISEILEEEEHHLILAQESLEWIGKSLFSTFLDMESFLNLSHLSEVRPYLAVNDPRLLEITEESWEVVSHFINVTSAFKKAQILFKNNEHSRMKKKLESVQELLETFIYKSLKRSYRELGCLSEKMRIIHDNPLFPWVQDQQKYAHAKNEFGEIARCLEEFEKTFFWLDEECAISYMDCWDFLNESIQNKKSRVDRDYISTKKIALKDRARTYAKVLLEENPTTEGKIDLQDAQRAFERQSQEFYTLEHTETKVRLEALQQCFSDLREATNVRQVRFTNSENANDLKESFEKIDKERVRYQKEQRLYWETIDRNEQELREEIGESLRLQNRRKGYRAGYDAGRLKGLLRQWKKNLRDVEAHLEDATMDFEHEVSKSELCSVRARLEVLEEELMDMSPKVADIEELLSYEERCILPIRENLERAYLQYNKCSEILSKAKFFFPEDEQLLVSEANLREVGAQLKQVQGKCQERAQKFAIFEKHIQEQKSLIKEQVRSFDLAGVGFLKSELLSIACNLYIKAVVKESIPVDVPCMQLYYSYYEDNEAVVRNRLLNMTERYQNFKRSLNSIQFNGDVLLRDPVYQPEGHETRLKERELQETTLSCKKLKVAQDRLSELESRLSRR

SEQ ID NO: 129 - protein, 341 aa, Chlamydia pneumoniae
  CPn0127
ESFMFPSANQESRTRNVPLGIFHGLVACLYWGIVFVIPNFLGSFGDLDIVLTRYTIFGIFSLIACAIKNPSVIKKTPLYIWRKSLLWTLLINPVYYFGITLGIRYVGSAITVVIASLAPTAVLYHSNTKQKELPYSLLFAISSVIITGVILTHLSALNLPTAASPLYSILGVIAVILSTSLWVIYVIRNQSLLEKHPNLTPDTWSYLIGISALIICLPMIIILDLCGITHVTHNLISHTPGSERLLFLLLCSAMGIFSSAKALIAWNKASLNLSPALLGAILIFEPIFGLVLTYLYSQSLPSLQEGIGIFLMLGGSLLCLVLFGRKVQKSLENSQVSSSNE

SEQ ID NO: 130 - protein, 264 aa, Chlamydia pneumoniae
  CPn0128
EDRGRMLRNQVLVYCSEGVSPYYLRHTIRFLKYYSTQEGAFDILRVDGNFLIKNPFWEETTRLLVFPGGADRPYHRVLHGLGTARIFQYVSEGGNFLGICAGAYFGSKMIYFYEPEGAPLQGARDLGFFPGTAKGPAYRGNFSYVSPSGVRVSPQLFSDFGLGYAMFNGGCFFEGSEGYPGVNIESRYDDLPGKPASIVSRIVSKGLAVLSGPHIEYLPHYCRMVKENVQKTREFLQRERTTLDRYCQNLVQRLRQPAFSKADC

SEQ ID NO: 131 - protein, 228 aa, Chlamydia pneumoniae
  CPn0129
DEQYILSHIHMDPRIFVTSEPLQKTYQKLQEKHVNNLGIASQVSLTDLQNKTQYENNLIETTTNEITYYFPVVHNPDILRSEWDPISNQLYLIFKKFFIHYHNLFSTALERNQILLIDSLNTGSSNPIARQMELLAFLCVFEQLDYNEDEYTIEPRDYFNRFVYKNSQTAPQIQSFGLLHGYEEMSYASNNIRNVLTHSIVLCSPILYQLITEFDTTKIHADDFDCLI

SEQ ID NO: 132 - protein, 167 aa, Chlamydia pneumoniae
  CPn0130
SSMVKCSSIIHENKKPAQLLPESKFAAITKLSLAILSLFLGIAACILIALSGLLPNTLLIIALSLISIIVLSTGISLLIGTQCSKSVQKDEQKPKSIFPKETPSLDPWLLNPLKNKIQSSETLLLDPTSINLKNELFFPSFEEWKKIFLKDPDFLIKSALANWKILE

SEQ ID NO: 133 - protein, 380 aa, Chlamydia pneumoniae
  CPn0131
FSSLKKERFSLSLAIFLIFFFTSAYVFPSICFLELFMENAMSSSFVYNGPSWILKTSVAQEVFKKHGKGIQVLLSTSVMLFIGLGVCAFIFPQYLIVFVLTIALLMLAISLVLFLLIRSVRSSMVDRLWCSEKGYALHQHENGPFLDVKRVQQILLRSPYIKVRALWPSGDIPEDPSQAAVLLLSPWTFFSSVDVEALLPSPQEKEGKYIDPVLPKLSRIERVSLLVFLSAFTLDDLNEQGVNPLMNNEEFLFFINKKAREHGIQDLKHEIMSSLEKTGVPLDPSMSFQVSQAMFSVYRYLRQRDLTTSELRCFHLLSCFKGDVVHCLASFENPKDLADSDFLEACKNVEWGEFISACEKALLKNPQGISIKDLKQFLVR

SEQ ID NO: 134 - protein, 326 aa, Chlamydia pneumoniae
  CPn0132
SMIEFAFVPHTSVTADRIEDRMACRMNKLSTLAITSLCVLISSVCIMIGILCISGTVGTYAFVVGIIFSVLALVACVFFLYFFYFSSEEFKCASSQEFRFLPIPAVVSALRSYEYISQDAINDVIKDTMQLSTLSSLLDPEAFFLEFPYFNSLIVNHSMKEADRLSREAFLILLGEITWKDCETKILPWLKDPNITPDDFWKLLKDHFDLKDFKKRIATWIRKAYPEIRLPKKHCLDKSIYKGCCKFLLLSENDVQYQRLLHKVCYFSGEFPAMVLGLGSEVPMVLGLPKVPKDLTWEMFMENMPVLLQSKREGHWKISLEDVASL

SEQ ID NO: 135 - protein, 262 aa, Chlamydia pneumoniae
  CPn0133
NSSAYMFKLLKNLFLIGCCIVGYFWMRKESIVEQWLSNRLHTQVTVGRVSIRTSGIKIRHICIHNPLASERFPYAAEIEYADVRFSSISMLLTKQLEISELIIHGANFTIFPYDSHGTKTNWSLVWKNFHPQKETPSNLWIDRAPVLIRRCLFLNTRLYGLRANHKDIPHLSVPSLEFHSHTSSAKELPKLSEALPSLLYLALEESLYHLNLPGDIIKPLSQQAHKHFYSSYPQFQDRLNDINTPGTPTEEIIGFIRGLFFH

SEQ ID NO: 136 - protein, 555 aa, Chlamydia pneumoniae
  CPn0134
FADYRKLRRTTMAAKNIKYNEEARKKIHKGVKTLAEAVKVTLGPKGRHVVIDKSFGSPQVTKDGVTVAKEIELEDKHENMGAQMVKEVASKTADKAGDGTTTATVLAEAIYSEGLRNVTAGANPMDLKRGIDKAVKVVVDELKKISKPVQHHKEIAQVATISANNDSEIGNLIAEAMEKVGKNGSITVEEAKGFETVLDVVEGMNFNRGYLSSYFSTNPETQECVLEDALILIYDKKISGIKDFLPVLQQVAESGRPLLIIAEEIEGEALATLVVNRLRAGFRVCAVKAPGFGDRRKAMLEDIAILTGGQLVSEELGMKLENTTLAMLGKAKKVIVTKEDTTIVEGLGNKPDIQARCDNIKKQIEDSTSDYDKEKLQERLAKLSGGVAVIRVGAATEIEMKEKKDRVDDAQHATIAAVEEGILPGGGTALVRCIPTLEAFLPMLANEDEAIGTRIILKALTAPLKQIASNAGKEGAIICQQVLARSANEGYDALRDAYTDMIDAGILDPTKVTRSALESAASIAGLLLTTEALIADIPEEKSSSAPAMPSAGMDY

SEQ ID NO: 137 - protein, 102 aa, Chlamydia pneumoniae
  CPn0135
MSDQATTLRIKPLGDRILVKREEEEATARGGIILPDTAKKKQDRAEVLVLGTGKRTDDGTLLPFEVQVGDIILMDKYAGQEITIDDEEYVILQSSEIMAVLK

SEQ ID NO: 138 - protein, 617 aa, Chlamydia pneumoniae
  CPn0136
KGVPSLMTTELKTEALPTRTQVDPKHCWDTTLMYANREEWKKDFDLCSSGKDRSPIWPEFSPSHYQIDNPESLLELLSKKFSVERKLDQLYIYAHLIHDQDITNPEGESDYQSIVYLYTLFSQEISWIQPALIALSEEKVAALLSSSVLAPYRFYLEKIFRLSPHTGTANEEKILASSFAALNVSNKAFSSLSDAEIPFGIAKDSNGEEHPLSHALASLYMQSPDQELRRTAYLAQFQRYYDYRNTFANLLNGKVQAHLFEAKARNYPSCLEASLFQHNIPTTVYINLINETKKHTSLINRYFNLKKEALNLKEFHFYDVYAPISQTTSKNYSYEEGVDLVCKSLLPLGTHYVEILRNGLLSNRWVDRYENKHKRSGAYSSGCYDSAPYILLNYTNTLYDVSVIAHEAGHSMHSYFSREAQPYHDAQYPLFLAEIASTFNEMLLMEALSKSDQSKEDKIVIITKTLDTIFATLFRQTFFAAFEYEIHSAAEQGTPLTEEFLSATYGNLQKEFYGGVVTSDSLSALEWARIPHFYYNFYVYQYATGIIAALSFAEKILTQEPGALELYLKFLKSGRSDFPLNILKKSGLDMTTSAPLDKAFAFITKKIDLLSSLLSED

SEQ ID NO: 139 - protein, 254 aa, Chlamydia pneumoniae
  CPn0137
VCSMNVADLLSHLETLLSSKIFQDYGPNGLQVGDPQTPVKKIAVAVTADLETIKQAVAAEANVLIVHHGIFWKGMPYPITGMIHKRIQLLIEHNIQLIAYHLPLDAHPTLGNNWRVALDLNWHDLKPFGSSLPYLGVQGSFSPIDIDSFIDLLSQYYQAPLKGSALGGPSRVSSAALISGGAYRELSSAATSQVDCFITGNFDEPAWSTALESNINFLAFGHTATEKVGPKSLAEHLKSEFPISTTFIDTANPF

SEQ ID NO: 140 - protein, 465 aa, Chlamydia pneumoniae
  CPn0138
TNSRLFLAIKDQLLQNMWKLTKRNSMLNCSNQKHTVTFEEACQVFPGGVNSPVRACRSVGVTPPIVSSAQGDIFLDTHGREFIDFCGGWGALIHGHSHPKIVKAIQKTALKGTSYGLTSEEEILFATMLLSSLKLKEHKIRFVSSGTEATMTAVRLARGITNRSIIIKFIGGYHGHADTLLGGISTTEETIDNLTSLIHTPSPHSLLISLPYNNSQILHHVMEALGPQVAGIIFEPICANMGIVLPKAEFLDDIIELCKRFGSLSIMDEVVTGFRVAFQGAQDIFNLSPDITIYGKILGGGLPAAALVGHRSILDHLMPEGTIFQAGTMSGNFLAMATGHAAIQLCQSEGFYDHLSQLEALFYSPIEEEIRSQGFPVSLVHQGTMFSLFFTESAPTNFDEAKNSDVEKFQTFYSEVFDNGVYLSPSPLEANFISSAHTEENLTYAQNIIIDSLIKIFDSSAQRFF

SEQ ID NO: 141 - protein, 198 aa, Chlamydia pneumoniae
  CPn0139
SPTKNKLRDIMKIPYARLEKGSLLVASPDINQGVFARSVILLCEHSLNGSFGLILNKTLGFEISDDIFTFEKVSNHNIRFCMGGPLQANQMMLLHSCSEIPEQTLEICPSVYLGGDLPFLQEIASSESGPEINLCFGYSGWQAGQLEKEFLSNDWFLAPGNKDYVFYSEPEDLWALVLKDLGGKYASLSTVPDNLLLN

SEQ ID NO: 142 - protein, 156 aa, Chlamydia pneumoniae
  CPn0140
PRSNQQKIFCMSLEKELLEETPLVLLNFYKLVSFCNYAGMILGTEEKKFAIYGHVSMGQAFQGADTEGHSPQRPFAHDLLNFVFSGFDIQVLRVVINDYKDNVFYTRLFLEQKDREFLYVVDVDARPSDSIPLALTHKIPILCVKSVFDAVVPYEE

SEQ ID NO: 143 - protein, 236 aa, Chlamydia pneumoniae
  CPn0141
HSSSAVEKDLHLHEKKCLAHEAATQVTSGMILGLGSGSTAKEFIFALAHRIQTESLAVHAIASSQNSYALAKQLAIPLLNPEKFSSLDLTVDGADEVDPQLRMIKGGGGAIFREKILLRAAKRSIILVDESKLVPVLGKFRVPLEISRFGRSAIIEEIRHLGYEGEWRLQDTGDLFITDSSNYIYDIFSPNSYPNPEKDLLKLIQIHGVIEVGFVIEKVEVWSSNSQGLISKKYSV

SEQ ID NO: 144 - protein, 102 aa, Chlamydia pneumoniae
  CPn0142
SHSYSKSKGTLEKFHFKILQLLSTKNSILNFCSHFEISRVSHDNAIQKIRSYPLKPIAENRINTLSFKDLKIDYPKDSSKRFRFLYSIGRIPLHKLWEYFVT

SEQ ID NO: 145 - protein, 378 aa, Chlamydia pneumoniae
  CPn0143
RRTIMNTSLKRPLKSHFDVVGSFLRPEHLKKTRESLKEGSISLDQLMQIEDIAIQDLIKKQKAAGLSFITDGEFRRATWHYDFMWGFHGVGHHRATEGVFFDGERAMIDDTYLTDKISVSHHPFVDHFKFVKALEDEFTTAKQTLPAPAQFLKQMIFPNNIEVTRKFYPTNQELIEDIVAGYRKVIRDLYDAGCRYLQLDDCTRGGLVDPRVCSWYGIDEKGLQDLIQQYLLINNLVIADRPDDLVVNLHVCRGNYHSKFFASGSYDFIAKPLFEQTNVDGYYLEFDHERSGDFSPLTFISGEKTVCLGLVTSKTPTLENKDEVIARIHQAADYLPLERLSLSPQCGFASCEIGNKLTEEEQWAKVALVKEISEEVWK

SEQ ID NO: 146 - protein, 873 aa, Chlamydia pneumoniae
  CPn0144
KVLGVNFMEKFSDAVSEALEKAFELAKSSKHTYVTENHLLLALLENTESLFYLVIKDIHGNPGLLNTAVKDALSREPTVVEGEVDPKPSPGLQTLLRDAKQEAKTLGDEYISGDHLLLAFWSSNKEPFNSWKQTTKVSFKDLKNLITKIRRGNRMDSPSAESNFQGLEKYCKNLTALAREGKLDPVIGRDEEIRRTIQVLSRRTKNNPMLIGEPGVGKTAIAEGLALRLIQGDVPESLKGKQLYVLDMGALIAGAKYRGEFEERLKSVLKDVESGDGEHIIFIDEVHTLVGAGATDGAMDAANLLKPALARGTLHCIGATTLNEYQKYIEKDAALERRFQPIFVTEPSLEDAVFILRGLREKYEIFHGVRITEGALNAAVLLSYRYIPDRFLPDKAIDLIDEAASLIRMQIGSLPLPIDEKERELAALIVKQEAIKREQSPSYQEEADAMQKSIDALREELASLRLGWDEEKKLISGLKEKKNSLESMKFSEEEAERVADYNRVAELRYSLIPQLEEEIKQDEASLNQRDNRLLQEEVDERLIAQVVANWTGIPVQKMLEGEAEKLLILEESLEERVVGQPFAVSAVSDSIRAARVGLNDPQRPLGVFLFLGPTGVGKTELAKALADLLFNKEEAMVRFDMSEYMEKHSISKLIGSSPGYVGYEEGGSLSEALRRRPYSVVLFDEIEKADKEVLNILLQVFDDGILTDGKKRKVNCKNALFIMTSNIGSPELADYCSKKGSELTKEAILSVVSPVLKRYLSPEFMNRIDEILPFVPLTKEDIVKIVGIQMRRIAQRLKARRINLSWDDSVILFLSEQGYDSAFGARPLKRLIQQKVVILLSKALLKGDIKPDTSIELTMAKEVLVFKKVETPS

SEQ ID NO: 147 - protein, 551 aa, Chlamydia pneumoniae
  CPn0145
NCAASFIWLNKSSHRNLRSPMFKSFIVRYMFVGGLVSFLLPIPDLECANNVTKTYDKKASVISRDLKLQEDCQKFWNLDPYKLESLCAYQVLYHDDYSSKRIRELFPQIQKDEVPIFATMILTLGKVDRGFSPEEISLIQKLSYPGLSLASLRGSTEIDPNTDLARALVVSEFSGDLGKNRADYYSNCLDILALRIHAERQRYLDQSPCVPGTSEFHKATIEAINTILFYEEAVRYPSKKEMFSDEFSFLSSVTDRKFGVCLGVSSLYFSLSQRLDLPLEAVTPPGHIYLRYQGGEVNIETTAGGRHLPTASYCDCLDLEDLQVRTPEEMIGLTFMNQGSFALQKKKYKEAEEAYKKAQEYLGDEELQELLGFVQILGGKKKEGKSLIGKSPRASQKGSVAYDYLKGRINIPTLALLFSYPGSNYEEIASYEEELKKAMKSSMPCCEGQRRLASVAFHLGKTAEAVALLEKCVEDIPNDLSLHLRLCKILCDRHEYTKALKYFIIAERLMEDQGFLKKDNRSFALFYEVKKIISKVAPQKANTLLLMESER

SEQ ID NO: 148 - protein, 167 aa, Chlamydia pneumoniae
  CPn0146
IIVGISMSSSEVVFQTVHGLGFGGLSSKSVVPFKKSLSDAPRVVCSILVLTLGLGALVCGIAITCWCVPGVILMGGICAIVLGAISLALSLFWLWGLFSNCCGSKRVLPGEGLLRDKLLDGGFSRAAPSGMGLPGDGSPRASTPSCLEELQAEIQAVTQAIDQMSDD

SEQ ID NO: 149 - protein, 153 aa, Chlamydia pneumoniae
  CPn0147
HGGPMAVQSIKEAVTSAATSVGCVNCSREAIPAFNTEERATSIARSVIAAIIAVVAISLLGLGLVVLAGCCPLGMAAGAITMLLGVALLAWAILITLRLLNIPKAEIPSPGNNGEPNERNSATPPLEGGVAGEAGRGGGSPLTQLDLNSGAGS

SEQ ID NO: 150 - protein, 627 aa, Chlamydia pneumoniae
  CPn0148
GKWWRVSSMESEKDIGAKFLGDYRILYRKGQSLWSEDLLAEHRFIKKRYLIRLLLPDLGSSQPFMEAFHDVVVKLAKLNHPGILSIENVSESEGRCFLVTQEQDIPILSLTQYLKSIPRKLTELEIVDIVSQLASLLDYVHSEGLAQEEWNLDSVYIHILNGVPKVILPDLGFASLIKERILDGFISDEENRESKIKERVLLHTSEGKQGREDTYAFGAITYYLLFGFLPQGIFPMPSKVFSDFIYDWDFLISSCLSCFMEERAKELFPLIRKKTLGEELQNVVTNCIESSLREVPDPLESSQNLPQAVLKVGETKVSHQQKESAEHLEFVLVEACSIDEAMDTAIESESSSGVEEEGYSLALQSLLVREPVVSRYVEAEKEEPKPQPILTEMVLIEGGEFSRGSVEGQRDELPVHKVILHSFFLDVHPVTNEQFIRYLECCGSEQDKYYNELIRLRDSRIQRRSGRLVIEPGYAKHPVVGVTWYGASGYAEWIGKRLPTEAEWEIAASGGVAALRYPCGEEIEKSRANFFTADTTTVMSYPPNPYGLYDMAGNVYEWCQDWYGYDFYEISAQEPESPQGPAQGVYRVLRGGCWKSLKDDLRCAHRHRNNPGAVNSTYGFRCAKNIN

SEQ ID NO: 151 - protein, 665 aa, Chlamydia pneumoniae
  CPn0149
ERFMKEENSQAHYLALCRELEDHDYSYYVLHRPRISDYEYDMKLRKLLEIERSHPEWKVLWSPSTRLGDRPSGTFSVVSHKEPMLSIANSYSKEELSEFFSRVEKSLGTSPRYTVELKIDGIAVAIRYEDRVLVQALSRGNGKQGEDITSNIRTIRSLPLRLPEDAPEFIEVRGEVFFSYSTFQIINEKQQQLEKTIFANPRNAAGGTLKLLSPQEVAKRKLEISIYNLIAPGDNDSHYENLQRCLEWGFPVSGKPRLCSTPEEVISVLKTIETERASLPMEIDGAVIKVDSLASQRVLGATGKHYRWALAYKYAPEEAETLLEDILVQVGRTGVLTPVAKLTPVLLSGSLVSRASLYNEDEIHRKDIRIGDTVCVAKGGEVIPKVVRVCREKRPEGSEVWNMPEFCPVCHSHVVREEDRVSVRCVNPECVAGAIEKIRFFVGRGALNIDHLGVKVITKLFELGLVHTCADLFQLTTEDLMQIPGIRERSARNILESIEQAKHVDLDRFLVALGIPLIGIGVATVLAGHFETLDRVISATFEELLSLEGIGEKVAHAIAEYFSDSTHLNEIKKMQDLGVCISPYHKSGSTCFGKAFVITGTLEGMSRLDAETAIRNCGGKVGSSVSKQTDYVVMGNNPGSKLEKARKLGVSILDQEAFTNLIHLE

SEQ ID NO: 152 - protein, 1562 aa, Chlamydia pneumoniae
  CPn0150
IIYYKFFYSYNCPYFISFFVLLGVNMASSSNNSTKQDGIPSWVNPNVQWNRASQVGDQEANSLTPEAQTSRSWFSDRKHFLEVLDVSLEEMENNDLKKYSRYKTIILIATLVTVAITCIVPISMVFGIPMWVPCLILFGAGLSSAFLSHRLQSKCKEIHLRYRAYQIYRQQLLSQYPDLRKSTLYKYSITHVKPKKGFVGKLVENLRPDLHKNKDDGGAAADSRLDFAGYGVKHYQTDALLGVSGVNSVEWQRLASLIMSVKNDILNDVGSREPIDKAQRSALVVSGKDIGGEIQPGGILDISRDILAICGYGMNVGVEAKKAIDQYKKWYLNSSTFIAWNPQLPAIAQSYLLEQQRHLDYAAKIFQDLSALTTAHGTGQALEDLDSLLCYYDQLIESKGVGEKIIASIHQKHLDLAMQDSCDQEHLKKWSNLYHVFSITIKEFTEGKLEQNEVVSRIQRLRGKLEKSKCSILGNCRTNAEYATKSEKKLADYLLQIGDREPFLTGMHKAIATGKAIQGKVEGVISQHPEKQIMMLRCSIERLEGMLRREDWGAILQKNEDEVLALKSTMEAQLQGFKDLVGTWEGKYQEFKKNKLSKVLVYDFTKSYSNLLNRLEVLHAESSTDDLVLHVDRMSEDLKKTIEEIDGNLFQVTPEELSLLAREYQGLMNELPLIVQEGNRLQEAISSEGVSQGLMLLNSLLNRDEKINKNIESSRKNLVAIAKQARSDARNIDSQGLAPLIQRNRASLDNILQNMYLFNGSIRNIHALDTETLVATSSNMFSAMHTFDWNIYTNLLDVLEIQSKPAPAPMENPDLPGALPEEVQDAVAEDVSGTHRLHHQVLKRRCADLKNMISQLQKSINKWGMAKAIVLGIVAVLFCVLSAIFIGQNILSLLILSCVGLLLTQVCPLIFDRISKSKEFEKQVLETAQSLIPATKILPSEFNNKDLNRLAKLQDNLNLEGFGPTWARNIVSDLEGIPTKEKSLKDLTKEFRKDSKNLNKRIKRRFKEGLGQEAPVVRPTIPQDIRGAEVFAELHRELEHLQKQKEEISIRGDALVQERMGLCLEKSKYDNEKAHAAAMTKKVGKLQNIDRLQKNNETYVRIQNFFRTLIQEKLGRDTVQEIDVVKEAKELHELAAIIYGNTSGKSQKQRAKKQFKENVLHIAGKGQLELLEAYLNVTASQGLCRHQMQASFRERILLNPDGAKHGEAERTLASREEMLKTLGLSYLTPFVRFSSPESTQSGYNQILKVREQLFDIEQRLQNQETVSPEDYAAVQAALAAYVRKHESLIVSTYGLGAQEGQTSSKVTTLMRDLHAVEELVEMGVETYRLNRSDQILHRVHSVLHSHLRDCDSSGNGIIDVVKKLFELLNNNGNNPNDPECQKYMQILLDAPVSLLYGAFKSFKNEFLLNFTELNIANSTKAAEEEAKRYVEEKGRGFETYWEEAKQRLEAIAAELDDLRNQETLLEQEIRLANLKISIFSDLNLREKVSVEKAALEEEIQGIQEQYAEMQGIEDLELKQKFEDLQKKLEALEERLLQIGRRIDSSVDKQKELLGLLGREEAA

SEQ ID NO: 153 - protein, 518 aa, Chlamydia pneumoniae
  CPn0151
CYENLFHYPRASMADILVIGANPTGLILANMLIQHGISVKVIDHRASPEDPSFLDCRKLPVILSCSSLELLHNSEMLGDFIQANHKIFGARYHWKKRTLLFKFSQATDSPVPFSLSTTYQSLEQHLIDEFLKRGGVIDWSTRPVTLVDNSIFIESTKVSQNFENREIYNPKWIIACEADNNLDIRDLVKSQLRARRINREVIFINCDEGEPFEEDHIHLLPITKNFLNFVFYNPQEKTKQLCLPQGTHSISPKLKQKLLYTYNLVISDENFHIKTSHHAFPPEHGNVLFLGSLSNTLLLSYLNGINTNIHAAFNLAWKLLPVLKKAALKHLVITKEQEDGNILPYISPTTEKRAKKLPFSRFYTPALMYYFLKGCRKFNTTGEEYYYPPHQALKYRSSDIIKMSPQDKEIHGPGPGMRAIDARLENGSFLLDPLKSSKHLLIFFKDIPDLKEALQEEYGEWIEICNVKEPRILNLYHANPNSLFIIRPDRYIGYRTHTFKLHELISYLLRIFASEKTS

SEQ ID NO: 154 - protein, 319 aa, Chlamydia pneumoniae
  CPn0152
LIKMRKVAFLVSCLFSVAIGASAAPVRVPGFPQIPEDLVQIKTEVCPKQEVCLAVTIKCDDHNLIGVLHLPNTPTPEGGFPTVVLFHGFRGTKFGGLTGAYRKLGRKFAAVGIATLRVDMAGCGDSEGVAEEVPIETYLRDAQTILETVQEHPDLNAYRLGISGFSLGCHIAFELAKIYNPRDLNIKALSVWAPIADGGILLKELYENFSKHGEGDIISVGKDFGFGPPPIIVCSGDVDLLIRIQDHVTANSLPTKPYILHQQGIDDTLVSRTQQTLFKNTAPGRMTFISYPNTGHNLATAPDLDMILDQIVSHFQRTL

SEQ ID NO: 155 - protein, 821 aa, Chlamydia pneumoniae
  CPn0153
NMRYDPNLIEKKWQQFWKEHRSFQANEDEDKVKYYVLDMFPYPSGAGLHVGHLIGYTATDIVARYKRARGFSVLHPMGWDSFGLPAEQYAIRTGTHPKVTTQKNIANFKKQLSAMGFSYDEGREFATSDPDYYHWTQKLFLFLYDQGLAYMADMAVNYCPELGTVLSNEEVENGFSIEGGYPVERKMLRQWILKITAYADKLLEGLDALDWPENVKQLQKNWIGKSEGALVTFHLTQEGSLEAFTTRLDTLLGVSFLVIAPEHPDLDSIVSEEQRDEVTAYVQESLRKSERDRISSVKTKTGVFTGNYAKHPITGNLLPVWISDYVVLGYGTGVVMGVPAHDERDREFAEMFSLPIHEVIDDNGVCIHSNYNDFCLNGLSGQEAKDYVINYLEMRSLGRAKTMYRLRDWLFSRQRYWGEPIPIIHFEDGTHRPLEDDELPLLPPNIDDYRPEGFGQGPLAKAQDWVHIYDEKTGRPGCRETYTMPQWAGSCWYYLRFCDAHNSQLPWSKEKESYWMPVDLYIGGAEHAVLHLLYSRFWHRVFYDAGLVSTPEPFKKLINQGLVLASSYRIPGKGYVSIEDVREENGTWISTCGEIVEVRQEKMSKSKLNGVDPQVLIEEYGADALRMYAMFSGPLDKNKTWSNEGVGGCRRFLNRFYDLVTSSEVQDIEDRDGLVLAHKLVFRITEHIEKMSLNTIPSSFMEFLNDFSKLPVYSKRALSMAVRVLEPIAPHISEELWVILGNPPGIDQAAWPQIDESYLVAQTVTFVVQVNGKLRGRLEVAKEAPKEEVLSLSRSVVAKYLENAQIRKEIYVPNKLVNFVL

SEQ ID NO: 156 - protein, 443 aa, Chlamydia pneumoniae
  CPn0154
TSEFCPMMLRGVHRIFKCFYDVVLVCAFVIALPKLLYKMLVYGKYKKSLAVRFGLKKPHVPGEGPLVWFHGASVGEVRLLLPVLEKFCEEFPGWRCLVTSCTELGVQVASQVFIPMGATVSILPLDFSIIIKSVVAKLRPSLVVFSEGDCWLNFIEEAKRIGATTLVINGRISIDSSKRFKFLKRLGKNYFSPVDGFLLQDEVQKQRFLSLGIPEHKLQVTGNIKTYVAAQTALHLERETWRDRLRLPTDSKLVILGSMHRSDAGKWLPVVQKLIKEGVSVLWVPRHVEKTKDVEESLHRLHIPYGLWSRGANFSYVPVVVVDEIGLLKQLYVAGDLAFVGGTFDPKIGGHNLLEPLQCEVPLIFGPHITSQSELAQRLLLSGAGLCLDEIEPIIDTVSFLLNNQEVREAYVQKGKVFVKAETASFDRTWRALKSYIPLYKNS

SEQ ID NO: 157 - protein, 70 aa, Chlamydia pneumoniae
  CPn0155
NSLSFGVPFLEKLKISLIPIEEMRHELFMKTHNSSSNGFSNQEKGIRTYFKSDLLGYEDLYFLRENINPN

SEQ ID NO: 158 - protein, 126 aa, Chlamydia pneumoniae
  CPn0156
LGKQKLLARHMMHNIVVLSEEPGRSAFLGRTAFFPNKYPIAQGGVGIPSTIGNLFTIWYCFYFYRAATPQSDHPDGCGFILLERLKELGAGFFYCDLRESNTTGFTLFFEGSNKGVLKNHLFIRDE

SEQ ID NO: 159 - protein, 152 aa, Chlamydia pneumoniae
  CPn0157
FSFVTYKEALMNIYQFSPGASPNWQASLMAQLNSYFCLGGETVTRIISLRPSGLILAKKEKAVVSTAEKILKILSFILFPLVLIALAIRYLLYNKFNKDLDRAVFFIPTEITKAEELIIAKNPALVKEAALTVSPLFYSLPKKYQLMKVETP

SEQ ID NO: 160 - protein, 190 aa, Chlamydia pneumoniae
  CPn0158
PPKITLSINIDLLLEDLDTDSIPWPKLYLSEDFDFAYYPESKAIIDTVAKLEKNNPGEEFCLESKKILARYLLEQLFKLETGLNFPTSTIDGGRESFLIEFSHETKKPTVWAFIYFYYYHSNGPKLEKDFKQAGCEVHNRLLNLGLKYRPQAGAQNDGRNGGPYGPIGFLIVWEENYGSVLKDHGFIKDN

SEQ ID NO: 161 - protein, 115 aa, Chlamydia pneumoniae
  CPn0159
CCFGGETATRIFSMTPSGFSLATEEKVQVSTAEKVIKILALIFFPIILIALAIRYFLHRKFDRKCFVIPQDTPKELELILAANPQLVEKAAREVHPGFFALPTKYQSMYIQTSKG

SEQ ID NO: 162 - protein, 556 aa, Chlamydia pneumoniae
  CPn0160
TVELLSLNKSYFEIQRLRYRPEILTLLETIRSKHIQETSSPPSPPPELQKHIPNLCRIPEVSIYTEQETSSKPLKIGVLLSGGQAPGGHNVVIGLFDALRVFNPKTRLFGFIKGPLGLTRGLYKDLDISVIYDYYNMGGFDMLSSSREKIKTEEQKKNILNTVKQLKLDGLLIIGGNNSNTDTAMLAEYFLAHNCKTSVIGVPKTIDGDLKNCWIETSLGFHTSCRTYSEMIGNLAKDALSAKKYHHFIRLMGQQASYTTLECGLQTLPNIALISELIATRKISLKQLSEQLALGLVRRYKSGKNYSTVLIPEGLIEHIFDTRKLIDELNVLLANGDSSIEKILSKLSPETLKTFHLFPKDIANQLLLARDSHGNVRVSKIATEELLAVMVKKEIEKIKPHMEFHSVSHFFGYEARAGFPSNFDCNYGIALGIISALFLVRQKTGYMITINNLAQSYTEWQGGATPLYKMMHLENRCGTETPVIKTDSVDPKSPAVQHLLQQSDSCLVEDLYRFPGPLQYFGKEELIDQRPLTLLWENQTHSPFQALYSTSGKRSL

SEQ ID NO: 163 - protein, 287 aa, Chlamydia pneumoniae
  CPn0161
HRSSTSRKQEPLLITGVVLEKHEQRTMFSLTLLNNFTTFGLLHTPLHYNPPYPIVILLHGLASDKTGSKRSHVRLAQELTRLGIAALRVDLLGHGDCEGELMDFSLENYKQNIREIIEYTHSLLHIDQERLAIFGSSLGGTLALQTLPFFNKIKALAVWAPTISGELMAAEAQKNAPEVITMSQKGAITYAGMTLNPDFYTQFLKIDIVKELMPSARNLPPILYMQGEQDLLVSINHRTLFTEAFANQDKPITILTYPDVDHAFPFAESSALSDLTQWLKRELTSGE

SEQ ID NO: 164 - protein, 356 aa, Chlamydia pneumoniae
  CPn0162
FVYTLYNIQSPFRIMKLYSISSDVDTPWIFQLMSKVDSYLFLGGNRIKVVSIVMQEPNLIIGKVENVRISTIVKILKILSFLIFPLILIALALHYFLHAKYANHLLVSKILERAPQYVPIPGRSGDTASHYKLTTLVPVSQKNLQAMGSNPLEVEAALRTTKPSFFCVPAKYRQIIISSHGIRFSLDLEQLADDINLDSVSWPTEYLNSTMDFCSKADKRVIQNVQNLRTGTYINSVGKRSLLKFMLQHLFIDGITQENPEALPNNTSGRLTLFPSVRYIYSHFTPQNPTIWPQVFFRQGPLDEDRGGGFEILEQLQELGVRFPICPSQGPDNPNFQGFQGIRIYWEDSYQPNKEV

SEQ ID NO: 165 - protein, 189 aa, Chlamydia pneumoniae
  CPn0163
FEKAIVYCIKCKQIIKCISIIHTPTPATPLCTEGEIFPGPVDSAIQNDLERLLTVKKRPDIIREYLMRAGGSLVTTYPKEGQRLRSPEQLRVLDDLVQSYPNHLHAIELDCGAIPQDLIGATYIITFADFSTYILSLRSYQANSPSDDTWGIWFGSIDDPVQAVISFLKDHGFALPSTLAQDPLLCTNK

SEQ ID NO: 166 - protein, 185 aa, Chlamydia pneumoniae
  CPn0164
LCFKCIYIKIIFSFLKQLMTRSTIESSDSLCSRSFSQKLSVQTLKNLCESRLMKITSLVIAFLTLIVGGALIALAGGGVLSFPLGLILGSVLVLFSSIYLVSCCKFFTLKEMTMTCSVKSKINIWFEKQRNKDIEKALENPDLFGENKRNVGNRSARNQLEMILHETDGIILKRYMKGAKMYFYL

SEQ ID NO: 167 - protein, 200 aa, Chlamydia pneumoniae
  CPn0165
NVLLFMNWVPKTIDHVDPESEIDIRKVVSCYKLIKECQPEFRSLISELLGVIRCGLRLLKRSKYQEQARTVSDEDAPLFCLTRSYYQDGYLTPLRAGPRDLINHYIHLRRRENPKHFFSPKHPCYYARLAFNESVCVYRELFDIERLTKMYVEGDYSKEQEKNLQAILSFVKTLDEGKDFLIEHKDTDLIGRGFTDVFCT

SEQ ID NO: 168 - protein, 123 aa, Chlamydia pneumoniae
  CPn0166
NCLKQYNKSDSIMSESINRSIHLEASTPFFIKLTNLCESRLVKITSLVISLLALVGAGVTLVVLFVAGILPLLPVLILEIILITVLVLLFCLVLEPYLIEKPSKIKELPKVDELSVVETDSTL

SEQ ID NO: 169 - protein, 111 aa, Chlamydia pneumoniae
  CPn0167
NLWSHFPRGFFMLPFCPTILLAKPFLNSENYGLERLAATVDSYFDLGQSQIVFLSKQDQGITVEELSAKDRKFKPGSMNCTLYTEDPILPAHNSFSNCSDIQMRTPISPIH

SEQ ID NO: 170 - protein, 100 aa, Chlamydia pneumoniae
  CPn0168
SYINLRRRENPEHFFNPGHPCYYARLAFNESVRIYRKLFNTAELKQMYGAGDYEQQNEDNLKSILSFVQILDEKDGFDDFLATHKDTTFIGRGGADIFCS

SEQ ID NO: 171 - protein, 276 aa, Chlamydia pneumoniae
  CPn0169
SFHIEFTIGENNMKNVGSECSQPLVMELNTQPLRNLCESRLVKITSFVIALLALVGGITLTALAGAGILSFLPWLVLGIVLVVLCALFLLFSYKFCPIKELGVVYNTDSQIHQWFQKQRNKDLEKATENPELFGENRAEDNNRSARSQVKETLRDCDGNVLKKIYERNLDVLLFMNWVPKTMDDVDPVSEDSIRTVISCYKLIKACKPEFRSLISELLRAMQSGLGLLSRCSRYQERAKTVSHKDAPLFCPTHSYYRDGYLTPLRAGPRYIINRAI

SEQ ID NO: 172 - protein, 358 aa, Chlamydia pneumoniae
  CPn0170
NVRKNHIIRGEKYNTCTVIAFVLSMSYDTLFKNLEKEDSVHKICNEIFALVPRLNTIACTEAIIKNLPKADIHVHLPGTITPQLAWILGVKNGFLKWSYNSWTNHRLLSPKNPHKQYSNIFRNFQDICHEKDPDLSVLQYNILNYDFNSFDRVMATVQGHRFPPGGIQNEEDLLLIFNNYLQQCLDDTIVYTEVQQNIRLAHVLYPSLPEKHARMKFYQILYRASQTFSKHGITLRFLNCFNKTFAPQINTQEPAQEAVQWLQEVDSTFPGLFVGIQSAGSESAPGACPKRLASGYRNAYDSGFGCEAHAGEGIETRTIFSSAKVNPEGLIEITRVTFSSLKRKQPSSLPIRVTCQLG

SEQ ID NO: 173 - protein, 432 aa, Chlamydia pneumoniae
  CPn0171
IIKLQSARRHLNTIFILDFGSQYTYVLAKQVRKLFVYCEVLPWNISVQCLKERAPLGIILSGGPHSVYENKAPHLDPEIYKLGIPILAICYGMQLMARDFGGTVSPGVGEFGYTPIHLYPCELFKHIVDCESLDTEIRMSHRDHVTTIPEGFNVIASTSQCSISGIENTKQRLYGLQFHPEVSDSTPTGNKILETFVQEICSAPTLWNPLYIQQDLVSKIQDTVIEVFDEVAQSLDVQWLAQGTIYSDVIESSRSGHASEVIKSHHNVGGLPKNLKLKLVEPLRYLFKDEVRILGEALGLSSYLLDRHPFPGPGLTIRVIGEILPEYLAILRRADLIFIEELRKAKLYDKISQAFALFLPIKSVSVKGDCRSYGYTIALRAVESTDFMTGRWAYLPCDVLSSCSSRIINEIPEVSRVVYDISDKPPATIEWE

SEQ ID NO: 174 - protein, 266 aa, Chlamydia pneumoniae
  CPn0172
APIGAAIGIGPLGISRAHHLVEAGANVLVIDTAHAHSKGVFQTVLEIKSQFPQISLVVGNLVTAEAAVSLAEIGVDAVKVGIGPGSICTTRIVSGVGYPQITAITNVAKALKNSAVTVIADGRIRYSGDVVKALAAGADCVMLGSLLAGTDEAPGDIVSIDEKLFKRYRGMGSLGAMKQGSADRYFQTQGQKKLVPGGVEGLVAYKGSVHDVLYQILGGIRSGMGYVGAETLKDLKTKASFVRITESGRAESHIHNIYKVQPTLNY

SEQ ID NO: 175 - protein, 109 aa, Chlamydia pneumoniae
  CPn0173
TIFDLIYKIDSYKHQQGFMDFSVFPDRFVESTSPSPIEDIDAKTLVSNCCHYCSRCLFIFLSLLSIIICFSVYGTSGETASLVFGILSLIVLVLLIIECRNRECCRRIS

SEQ ID NO: 176 - protein, 170 aa, Chlamydia pneumoniae
  CPn0174
KIFIWFVEKIVILSMIMTTISNSPSPALNPELSLIPPPTLVSSGTQTSLAYTIPAQGRRSTLRIILDIFIIILGLATIISTFIVIFFLNGLNLLSTPSIISSSCLIIVGLLFLIMGLYFMISSLDQGLVGLLQKELSQAEEREEEYIQEIEALRGAPRAESPTESPSTWL

SEQ ID NO: 177 - protein, 140 aa, Chlamydia pneumoniae
  CPn0175
LLLACFQFLLRRRDMEQPNCVIQDTTTVLYALNSFDPRLSDDTHRLGKQSPLEAENALGEFIEGLDTNSFPLEEVAIPILPGYHPKFYLSFIDRDDQGVHYEVLDGVFLKTVAACIIENSFLTDSMSPELLSEVKEALKR

SEQ ID NO: 178 - protein, 416 aa, Chlamydia pneumoniae
  CPn0176
NDDDPMDESDGEEASKDSAFSASFSYEFVKSSTRESKNTVTHSTASRTLYILRQDCSYDPRALKVDDEFRYWVEKRLDAKNPDSLNAFVKEVGTHYVASVTYGGIGFQVLKMSYLQVEELEKEKISISVAAASSLLKSKTSNATEKGYSSYQSESSAQTVFLGGTVLPDLQQDKLDFKDWSESIPNEPIPLAISVSSITDLIIPELFPSEDAQVLSQKKSALGQVILNYLESHKPKEEGPKPVQITSGFNSSSSVFTLQAAKAPKTVSFPYIDYWSTIPYLFPTLKETSGAQPLSFYLRFDDIFEQQNLVHNTSYILASTSVRLGYFGDSYRDYDALSFYGSWPQAYFDWAGYKDRCTWTLEKLNTTGDLFIRSGDEIRLKHNTSGKYLATTSMSDGYQKLTCTTQTSDSVFIITV

SEQ ID NO: 179 - protein, 302 aa, Chlamydia pneumoniae
  CPn0177
DKREQTKSKFIFLISEESMKQPMSLIFSSVCLGLGLGSLSSCNQKPSWNYHNTSTSEEFFVHGNKSVSQLPHYPSAFRTTQIFSEEHNDPYVVAKTDEESRKIWREIHKNLKIKGSYIPISTYGSLMHPKSAALTLKTYRPHPIWINGYERSFNIDTGKYLKNGSRRRTSHDGPKNRAVLNLIKSSGRRCNAIGLEMTEEDFVIARRREGVYSLYPVEVCSYPQGNPFVIAYAWIADESACSKEVLPVKGYYSLVWESVSSSDSLNAFGDSFAEDYLRSTFLANGTSILCVHESYKKVPPQP

SEQ ID NO: 180 - protein, 88 aa, Chlamydia pneumoniae
  CPn0178
VKEYLDFLVQRNVERDPQTKRHCTVSQKFGGESIDAKTTTGQLFHIAGKTEPGHGKLCLGESILKQLLALGIITGYENREREVWVYLD

SEQ ID NO: 181 - protein, 165 aa, Chlamydia pneumoniae
  CPn0179
PKIWDTHFETRIEATSVPKFNRRLRKSFHKSGRSSRPSKACVANFFNFTLQAGRSGIIPGKKAILLNVNDAKTPNYSCIFESIGFFNEQDLEAQHNQQAALVRKILKVVPHHFLKGLIAKLPRSLKKDRKFMSSLIFTKLSYALDLSAPMHLEGKPNLSYEEKLD

SEQ ID NO: 182 - protein, 203 aa, Chlamydia pneumoniae
  CPn0180
TSLHKILDCKYKPVFIQNTVASETYPSQILHAQREVRDAYFNQADCHPARANQILEAKKICLLDVYHTNHYSVFTFCVDNYPNLRFTFVSSKNNEMNGLSNPLDNVLVEAMVRRTHARNLLAACKIRNIEVPRVVGLDLRSGILISKLELKQPQFQSLTEDFVNHSTNQEEARVHQKHVLLISLILLCKQAVLESFQEKKRSS

SEQ ID NO: 183 - protein, 133 aa, Chlamydia pneumoniae
  CPn0181
VHELFKIDGVYYFFKKFMKLFYNNYSLNSHHEKPSSLEKAVQALDSYFYWGGDTTDVLARDDISREIYCVRRLYIRFWIVSISQSLSRIPWRLKRILLRYCTLRGKYVMPILIKRIAILLGLIRFSRLRKSVY

SEQ ID NO: 184 - protein, 457 aa, Chlamydia pneumoniae
  CPn0182
RCIMKKVLIANRGEIAVRIIRACHDLGLSTVAVYSLADQEALHVLLADEAICIGEPQAAKSYLKISNILAACEITGADAVHPGYGFLSENANFASICESCGLTFIGPSSESIAMMGDKIAAKSLAKKIKCPVIPGSEGIIEDESEGLKIAEKIGFPIVIKAVAGGGGRGIRIVKEKDEFYRAFSAARAEAEAGFNNPNVYIEKFIENPRHLEIQVIGDTHGNYVHLGERDCTIQRRRQKLIEETPSPILNAEIRVKVGKVAVDLARSAGYFSVGTVEFLLDKDKKFYFMEMNTRIQVEHTITEEVTGIDLVKEQIHVAMGNKLPWKQKNIEFSGHIIQCRINAEDPTNNFSPSPGRLDYYLPPAGPSIRVDGACYSGYAIPPYYDSMIAKVIAKGKNREEAIAIMKRALKEFHIGGVQSTIPFHQFMLDNPKFLESNYDINYIDNLLAQGNSFFKEF

SEQ ID NO: 185 - protein, 171 aa, Chlamydia pneumoniae
  CPn0183
RRLGMDLKQIEKLMIAMGRNGMKRFAIKREGLELELERDTREGNRQEPVFYDSRLFSGFSQERPIPTDPKKDTIKETTTENSETSTTTSSGDFISSPLVGTFYGSPAPDSPSFVKPGDIVSEDTIVCIVEAMKVMNEVKAGMSGRVLEVLITNGDPVQFGSKLFRIAKDAS

SEQ ID NO: 186 - protein, 198 aa, Chlamydia pneumoniae
  CPn0184
QWKIKFCCCEEKIMVLSSQLSVGMFISTKDGLYKVTSVSKVAGPKGESFIKVALQAADSDVVIERNFKATQEVKEAQFETRTLEYLYLEDESYLFLDLGNYEKLFIPQEIMKDNFLFLKAGVTVSAMVYDNVVFSVELPHFLELMVSKTDFPGDSLSLSGGVKKALLETGIEVMVPPFVEIGDVIKIDTRTCEYIQRV

SEQ ID NO: 187 - protein, 231 aa, Chlamydia pneumoniae
  CPn0185
AEVKKQESVLVGPSIMGADLTCLGVEAKKLEQAGSDFIHIDIMDGHFVPNLTFGPGIIAAINRSTDLFLEVHAMIYNPFEFIESFVRSGADRIIVHFEASEDIKELLSYIKKCGVQAGLAFSPDTSIEFLPSFLPFCDVVVLMSVYPGFTGQSFLPNTIEKIAFARHAIKTLGLKDSCLIEVDGGIDQQSAPLCRDAGADILVTASYLFEADSLAMEDKILLLRGENYGVK

SEQ ID NO: 188 - protein, 397 aa, Chlamydia pneumoniae
  CPn0186
PIKDKILMSSPVNNTPSAPNIPIPAPTTPGIPTTKPRSSFIEKVIIVAKYILFAIAATSGALGTILGLSGALTPGIGIALLVIFFVSMVLLGLILKDSISGGEERRLREEVSRFTSENQRLTVITTTLETEVKDLKAAKDQLTLEIEAFRNENGNLKTTAEDLEEQVSKLSEQLEALERINQLIQANAGDAQEISSELKKLISGWDSKVVEQINTSIQALKVLLGQEWVQEAQTHVKAMQEQIQALQAEILGMHNQSTALQKSVENLLVQDQALTRVVGELLESENKLSQACSALRQEIEKLAQHETSLQQRIDAMLAQEQNLAEQVTALEKMKQEAQKAESEFIACVRDRTFGRRETPPPTTPVVEGDESQEEDEGGTPPVSQPSSPVDRATGDGQ

SEQ ID NO: 189 - protein, 276 aa, Chlamydia pneumoniae
  CPn0187
VFLTYTRTLPMHSKFLSRRKKNSSHKEETSWDCIASSYNKIVQDKGHYYHRETILPQLLPSLTLGSKSSVLDIGCGQGFLERALPKECRYLGIDISSRLIALAKKMRSVNSHQFKVADLSKRLEFVEPTLFSHAVAILSLQNMEFPGEAIRNTATLLEPLGQFFIVLNHPCFRIPRASSWHYDENKKAISRHIDRYLSPMKIPIMAHPGQKDSPSTLSFHFPLSYWFKELSSHGFLVSGLEEWTSSKTSTGKRAKAENLCRKEFPLFLMISCIKIK

SEQ ID NO: 190 - protein, 437 aa, Chlamydia pneumoniae
  CPn0188
KTLNSCIMFRKLFPFSKKKTGQKQRLRNNGLLQAIIQSIKVLLHNEASKEACVLSYYGLLTCVPILVFFLRLSQHLFTNLNWKEWLIIKFPDYKKPIVAIVEAAYHATESNIGLVLVGSFFVFCWAGILMLLSLEDGLNKIFRTSWTPISLKRLVSYFVITLVSPMIFIIVCGSWIYITQIMPIQYAKLFSLSHSMTALYFISRFVPYLLLYLALFCCYAFLPRVAIQKTSALISTLIIGSVWIVFQKAFFSLQVSIFNYSFTYGALVALPSFLLLLYIYTMIYLFGGALTFIIQNRGCTFIFLGDKILPSCYLQLITSTYILALTTRQFNEGLSPLTAQFIAKQSKVPIGEVSQCLDVLEKEGFLFPYNNGYQPVFNFSELTIKDIADKLLHREIFKKFNPDLGITFIENSFQNIFNQASKNKENLTLSEIARRIK

SEQ ID NO: 191 - protein, 1145 aa, Chlamydia pneumoniae
  CPn0189
ANQMKRRSWLKILGICLGSSIVLGFLIFLPQLLSTESRKYLVFSLIHKESGLSCSAEELKISWFGRQTARKIKLTGEAKDEVFSAEKFELDGSLLRLLIYKKPKGITLSGWSLKINEPASIDHPSVSHLDPGSLLTYLNDCKIISEHGFITMKTVSGSSLSVSGFYLEKSSEKFMTKCVVSEDQQSGNIFIESVLSPDVSISAQFSSVPVAFFKIFIASPFWDHLLSYEDIINLSAEATHTNDGKISMTASGEGNQIQMKLQGHIHKSTFYIVEGSSSFIELKPELASALCNQIIPLSTPITSKQIHATVSYAKIPLDITKWKHIEITSQAQLPEVAIHPKDPNLALQLRDTKLGIKKTEKFSDIRYSSSTVLGGASPSHLNGLISIDNKKHLTKFRLQQAQLPHTYLRAIFPQPFVINVPLDVAYYSLNIEGTYKNAHLEADAILDNPLLKLSCSMSGTWKNFLFKGQGTYHFNKKWQEILSPHFSYAEARFSGKAQITDTNLFFPKFSGKITARENELLIHAKFGSPNEPIKPETTSILIHGQFCSLPLSLVSNHLAPFHLKKLTFSFHTDGGKFVTKGNLQALIENPDYPDLNNTRILIPDLLLSLDESSTSPSSKDLKIQGSGEIFSLPLDSITKTYGKQVRLSPYFGSSGDLNFVVNYNPKDQNKLTLLSNFKSEALLGELKLVMDFSMKLSSGTQGTLQWEVSPERYASFFKNASCSPTCLLHRTANVRLDISKLSCPEETKGLSCLTLLAAGGLEGSLEATPLIFYDNVSKETFIINDFKGSLRANNLDAKIEYDLKGSCLAPRQDSKTLAEFSLEGQVDHLFSPESREFKQTANWIHIPSSFIAGIIPMSPGLKAQISSLAGPRINVSIKNAFRFGEGPVDIMVDSENLQAQIPLILNEKSILLRENLTAHLSINEDVNKAFLQEFNPLLAGGAYSQYPVTLEIDKQNFYLPIRPYSFEEFRIQSATLDMGKISIANTGTMYALFQFLDITDQKQFVESWFTPIFFSVQKGSIICKRLDALIDRRIRLALWGKTDIAHDRLFMTLGIDPEVIKKYFHNTSLKTKNFFLIKIRGSISSPEVDWSSAYARIALLKSYSLGNPFSSLADKLFSSLGDSTPPPTVHPFPWEKSNFDSIENK

SEQ ID NO: 192 - protein, 458 aa, Chlamydia pneumoniae
  CPn0190
LLGIKLMRKRHSFDSTSTKKEAVSKAIQKIIKIMETTDPSLNVETPNAEIESILQEIKEIKQKLSKQAEDLGLLEKYCSQETLSNLENTNASLKLSIGSVIEELASLKQLVEESIEESLGQQDQLIQSVLIEISDKFLSSIGETLSGNLDMNQNVIQGLLIKENPEKSEAASVGYVQTLLEPLSKRIGETHKKVATHDVNISSLQFHMMSVAGGRFRGHIDMNGYRVLGLGEPKNGEDAVSKDYLERYVSSQLTIDKVEDKPITKPNKGKLLYSQGTSPKLESPLPLGLLTSGISGFTWKSASKSNDGSFPFSALRHKETESDTDCFQITSTTLSGNQAGTYTWSLSLKVLVPSIFQIEKPEVQLSLVYSYEDWLPIDNIFNMSQPRTIPLALLGQTMLAGQKYDILELAAHQTNQTLMISPNCSRFSLQLKQTNQFENSPVDFYIVHAAHSCHWSGF

SEQ ID NO: 193 - protein, 242 aa, Chlamydia pneumoniae
  CPn0191
QHHFPVFLGYQKREGVMTIRVRNLAYSVNKKKILDGVTFSLERGHITLFVGKSGSGKTMILRALAGLVQPTQGDIWIEGEAPALVFQQPELFSHMTVLGNCTHPQIHIKGRSTEEAREKAFELLHLLDIEEVAKNYPDQLSGGQKQRVAIVRSLCMDKHTLLFDEPTSALDPFATASFRHLLETLRDQELTVGLTTHDMQFVHSCLDRIYLIDQGTVAGVYDKRDGELDSGHPLSKYIHSAQ

SEQ ID NO: 194 - protein, 220 aa, Chlamydia pneumoniae
  CPn0192
EVGVDHWLAIARLLLRGCGYTLCVSGIGILCGSILGLLIGTVTSLYFPSKLTKLLANSYVTVIRGTPLFIQILIIYFGLPEVLPIEPTPLVAGIIALSMNSAAYLAENIRGGINSLSIGQWESAMVLGYKKYQIFVYIIYPQVFKNILPSLTNEFVSLIKESSILMVVGVPELTKVTKDIVSRELNPMEMYLICAGLYFLMTTSFSCISRLSEKRRSYDN

SEQ ID NO: 195 - protein, 153 aa, Chlamydia pneumoniae
  CPn0193
KLHGVFMKKKVTIDEALKEILRLEGAATQEELCAKLLAQGFATTQSSVSRWLRKIQAVKVAGERGARYSLPSSTEKTTTRHLVLSIRHNASLIVIRTVPGSASWIAALLDQGLKDEILGTLAGDDTIFVTPIDEGRLPLLMVSIANLLQVFLD

SEQ ID NO: 196 - protein, 360 aa, Chlamydia pneumoniae
  CPn0194
EVPHTIKGNVFFSWFFMLTLGLESSCDETACAIVNEDKQILANIIASQDIHASYGGVVPELASRAHLHIFPQVINKALQQANLLIEDMDLIAVTQTPGLIGSLSVGVHFGKGIAIGAKKSLIGVNHVEAHLYAAYMAAQNVQFPALGLVVSGAHTAAFFIENPTSYKLIGKTRDDAIGETFDKVGRFLGLPYPAGPLIEKLALEGSEDSYPFSPAKVPNYDFSFSGLKTAVLYAIKGNNSSPRSPAPEISLEKQRDIAASFQKAACTTIAQKLPTIIKEFSCRSILIGGGVAINEYFRSAIQTACNLPVYFPPAKLCSDNAAMIAGLGGENFQKNSSIPEIRICARYQWESVSPFSLASP

SEQ ID NO: 197 - protein, 538 aa, Chlamydia pneumoniae
  CPn0195
YSGNSYMRKISVGICITILLSLSVVLQGCKESSHSSTSRGELAINIRDEPRSLDPRQVRLLSEISLVKHIYEGLVQENNLSGNIEPALAEDYSLSSDGLTYTFKLKSAFWSNGDPLTAEDFIESWKQVATQEVSGIYAFALNPIKNVRKIQEGHLSIDHFGVHSPNESTLVVTLESPTSHFLKLLALPVFFPVHKSQRTLQSKSLPIASGAFYPKNIKQKQWIKLSKNPHYYNQSQVETKTITIHFIPDANTAAKLFNQGKLNWQGPPWGERIPQETLSNLQSKGHLHSFDVAGTSWLTFNINKFPLNNMKLREALASALDKEALVSTIFLGRAKTADHLLPTNIHSYPEHQKQEMAQRQAYAKKLFKEALEELQITAKDLEHLNLIFPVSSSASSLLVQLIREQWKESLGFAIPIVGKEFALLQADLSSGNFSLATGGWFADFADPMAFLTIFAYPSGVPPYAINHKDFLEILQNIEQEQDHQKRSELVSQASLYLETFHIIEPIYHDAFQFAMNKKLSNLGVSPTGVVDFRYAKEN

SEQ ID NO: 198 - protein, 538 aa, Chlamydia pneumoniae
  CPn0196
KLKSYSKERSFMLRFFAVFISTLWLITSGCSPSQSSKGIFVVNMKEMPRSLDPGKTRLIADQTLMRHLYEGLVEEHSQNGEIKPALAESYTISEDGTRYTFKIKNILWSNGDPLTAQDFVSSWKEILKEDASSVYLYAFLPIKNARAIFDDTESPENLGVRALDKRHLEIQLETPCAHFLHFLTLPIFFPVHETLRNYSTSFEEMPITCGAFRPVSLEKGLRLHLEKNPMYHNKSRVKLHKIIVQFISNANTAAILFKHKKLDWQGPPWGEPIPPEISASLHQDDQLFSLPGASTTWLLFNIQKKPWNNAKLRKALSLAIDKDMLTKVVYQGLAEPTDHILHPRLYPGTYPERKRQNERILEAQQLFEEALDELQMTREDLEKETLTFSTFSFSYGRICQMLREQWKKVLKFTIPIVGQEFFTIQKNFLEGNYSLTVNQWTAAFIDPMSYLMIFANPGGISPYHLQDSHFQTLLIKITQEHKKHLRNQLIIEALDYLEHCHILEPLCHPNLRIALNKNIKNFNLFVRRTSDFRFIEKL

SEQ ID NO: 199 - protein, 457 aa, Chlamydia pneumoniae
  CPn0197
KNYRRKSLDLKFDSKFIKVIFKMFSRWITLFLLFISLTGCSSYSSKHKQSLIIPIHDDPVAFSPEQAKRAMDLSIAQLLFDGLTRETHRESNDLELAIASRYTVSEDFCSYTFFIKDSALWSDGTPITSEDIRNAWEYAQENSPHIQIFQGLNFSTPSSNAITIHLDSPNPDFPKLLAFPAFAIFKPENPKLFSGPYTLVEYFPGHNIHLKKNPNYYDYHCVSINSIKLLIIPDIYTAIHLLNRGKVDWVGQPWHQGIPWELHKQSQYHYYTYPVEGAFWLCLNTKSPHLNDLQNRHRLATCIDKRSIIEEALQGTQQPAETLSRGAPQPNQYKKQKPLTPQEKLVLTYPSDILRCQRIAEILKEQWKAAGIDLILEGLEYHLFVNKRKVQDYAIATQTGVAYYPGANLISEEDKLLQNFEIIPIYYLSYDYLTQDFIEGVIYNASGAVDLKYTYFP

SEQ ID NO: 200 - protein, 534 aa, Chlamydia pneumoniae
  CPn0198
QIEYYIMKMHRLKPTLKSLIPNLLFLLLTLSSCSKQKQEPLGKHLVIAMSHDLADLDPRNAYLSRDASLAKALYEGLTRETDQGIALALAESYTLSKDHKVYTFKLRPSVWSDGTPLTAYDFEKSIKQLYFEEFSPSIHTLLGVIKNSSAIHNAQKSLETLGIQAKDDLTLVITLEQPFPYFLTLIARPVFSPVHHTLRESYKKGTPPSTYISNGPFVLKKHEHQNYLILEKNPHYYDHESVKLDRVTLKIIPDASTATKLFKSKSIDWIGSPWSAPISNEDQKVLSQEKILTYSVSSTTLLIYNLQKPLIQNKALRKAIAHAIDRKSILRLVPSGQEAVTLVPPNLSQLNLQKEISTEERQTKARAYFQEAKETLSEKELAELSILYPIDSSNSSIIAQEIQRQLKDTLGLKIKIQGMEYHCFLKKRRQGDFFIATGGWIAEYVSPVAFLSILGNPRDLTQWRNSDYEKTLEKLYLPHAYKENLKRAEMIIEEETPIIPLYHGKYIYAIHPKIQNTFGSLLGHTDLKNIDILS

SEQ ID NO: 201 - protein, 322 aa, Chlamydia pneumoniae
  CPn0199
KCLIGLSLVFSYIKNRILFNLLSLWIVLTLTFLVMKTIPGDPFNDEGCNVLSEEVLQTLKSRYGLDKPLYQQYTQYLHSIAKLDFGNSLVYKDRKVTNIISTAFPISAILGLQSLFLSIGGGIALGTIAALKKKKQRRYILGASILQISIPAFIFATLLQYVFAVKIPLLPIACWGSFTHTILPTLALAVTPMAFIIQLTYSSVSAALNKDYVLLAYAKGLSPLKVVIKHILPYAIFPTISYSAFLTTTVITGTFAIENIFCIPGLGKWFICSIKQRDYPVALGLSVFYGTLFMLSSLLSDLIQSIIDPQIRYAHGKEKKRK

SEQ ID NO: 202 - protein, 291 aa, Chlamydia pneumoniae
  CPn0200
EKKKHKLMENLSSAPSRSIWKSIIQNKMLVLGLTTLIILMLGALLLPWFYQDYEQTSLKDILVSPCSRFPFGTDTLGRCMFARTLRGLRLSLLIATIATLIDVCVGLLWATVAISGGKKIDFLMMRTTEILFSLPRIPIIILLLVIFHHGLLPLILAMTITGWIPISRIIYGQFLLLKNKPFVLSAKAMHASTFHILKKHLLPNTLAPIISTLIFTIPNAIYTEAFISFLGLGIQPPQASLGTLVKEGINAIDYYPWLFFFPSLIMIALSISFNLIGEGAKTLCLEEGSHG

SEQ ID NO: 203 - protein, 302 aa, Chlamydia pneumoniae
  CPn0201
ASISSARGLKHYVSKRDLMDNYLLNIKDLTITSTNPKRTLIENLSLQLKENRNLALVGESGSGKTTITKAILGFLPENCLIKTGSILFEDIDITKLSPKELHKIRGQKIATILQNAMGSLTPSMRIGMQIIETLRQHHKMNKEEAYNKAMQLLTDVCIPNPKYSFSQYPFELSGGMRQRVVIAIALASQPKLILADEPTTALDSMSQAQVLRILRNIQQQKQATILLVTHNLSLVKELCNDICIIKDGKLIETGTVEEIFLSPKHPYTLKLLNAVSKIPIKKTSSPILKNKFQPLMSMQGGL

SEQ ID NO: 204 - protein, 273 aa, Chlamydia pneumoniae
  CPn0202
VPTSNEYARWFMTTLLSIKDLSLTIRGKKILNHINLNLIKGSYLTIVGPSGSGKSSLALTILDLLKPTTGTITFHMDPKIPRARKVQVIWQDIDSSLNPCMSIKGIISEPLNIIGTYSKAEQNKEIYNVLDLVNLPKSVLHLKPYKLSGGQKQRIAIAKALVSKPELLICDEPLSSLDTLNQSLILDLFQTIKKEYQNTLLFITHDMSAAYYIADTIAVMDQGSLVEHACREKIFSTPKHTTTQDLLDAIPIFSLISTEMEPSEEYELQVASK

SEQ ID NO: 205 - protein, 279 aa, Chlamydia pneumoniae
  CPn0203
IVPLPQKNNKETSCMNTYTFSPTLQKSFSLFLLEKLDSYFFFGGTRTQILVITPTNIRLAAKKRGCKVSTIEKIIKILSFILLPLVIIAFILRYFLHKKFDKQFLCIPKVISNEDEALLGSRPQAVEKAVREISPAFFSIPRKYQLIRIDTPKDDAPSILFPIGIEIILKDLCIDTLKQSNLFLKREMDFLGHPEEKALFDSICSIEKDQEWMSLESKKLLITHFLKYLFVSGIEQLNPGFNPENGRGYFSEISTAKIHFHQHGRYGPIRSSGPIMKEI

SEQ ID NO: 206 - protein, 104 aa, Chlamydia pneumoniae
  CPn0204
PREWAWVFFRNKYSKDPFSSARSIWANPFFGTHHEGNIKIKGMGYQIFTRLKKLGISFSSYNSINPNPYFFDEGCFVYWESQFKSALQDHGILQKQTETFYRNT

SEQ ID NO: 207 - protein, 85 aa, Chlamydia pneumoniae
  CPn0205
IEDSIKGYGSASAFRNPPQLLLKFFLVCEELCILTVATHRALLETPLALSFFKELKTKYVYRAKDILQLHNYKGFTILNTSPLCS

SEQ ID NO: 208 - protein, 272 aa, Chlamydia pneumoniae
  CPn0206
IVDRRSPACYDSINSDAIGVSLLMDISHILEDLAYDEGILPREAIEAAIVKQMQITPYLLHILHDATQRVPEIVNDGSYQGHLYAMYLLAQFRESRALPLIIKLFAFEDDTPHAIAGDVLTEDLPRILASVCNDDSLIKELIETPKINPYVKAAAISGLVTLVGAGKIPRDKVIRYFAELLNYRLEKQPSFAWDNLIAGICTLYPGELFYPISKAFDGGLVDTSFISMEDVENIIHEETVESCIHTLCSSTELINDTLEEMEKWLEDFPIEP

SEQ ID NO: 209 - protein, 470 aa, Chlamydia pneumoniae
  CPn0207
VNKKKRFLSLLFLTAVLLGIWFSPHPASINSNAWQLFAIFTTTIMGIIFQPVPMGAIAIIGISTLLLTQTLTLEQGLSGFHNPIAWLVFLSFSIAKGIIKTGLGERIAYFFVSALGKSPLGLSYGLVITDFFLAPAIPSVTARAGGILYPVVTSLSDSFGSSAEKGTQDLIGSFLIKVAYQSSVITSAMFLTAMAGNPLVAALAGHVGVSLSWVLWAKAAIIPGLPSLFLMPIILYKLYPPKITSCEEAIRSAKLRLKEMGPLKKEEKTILMIFFLLVVLWTFGDLLGISATTAALIGLSLLILTNILDWQKDVIANTTAWETFIWFGALIMMASFLNQLGFIPLVGDSAAALVSGLSWKIGFPLLFLIYFYSHYLFASNTAHIGAMYPIFLAVSISLGTNPIFAALTLAFASNLFGGLTHYGSGPAPLYFGSHLVTVQEWWRSGFALSIVNIVIWIGIGSLWWKALGLI

SEQ ID NO: 210 - protein, 556 aa, Chlamydia pneumoniae
  CPn0208
SVAVILMHPLYVDLDTIISSYSPPLPKEFQEAASLIAVPDTSHSKPVVPGVKTLFPQTYHLPYLKFVQGENVVHTPLKVGVMFSGGPAPGGHNVIQGLFNSLKDFHPDSSLVGFVNNGDGLTNNKSIDITEEFLSKFRNSGGFNCIGTGRKKIVTPEAKEACLKTAEALDLDGLVIIGGDGSNTATAILAEYFAKRRPKTSIVGVPKTIDGDLQHTFLDLTFGFDTATKFYSSIISNISRDALSCKAHYHFIKLMGRSASHIALECALQTHPNIALIGEEIAEKNLPLKTIIHKICSVIADRAAMEKYYGVILIPEGIIEFIPEIINLITEIESLSEYEDKISRLSPESQRLLKSFPAPIIEQILNDRDAHGNVYVSKISVDKLLIHLVSNHLQQYFPNVPFNAISHFLGYEGRSGLPTKFDNTYGYSLGYGAGILVRNHCNGYLSTIESLACPFMKWKLRAIPVVKMFTVKQQADGTLQPKIKKYLVDIGSTAFRKFKLYRKIWALEDSYRFLGPLQIETPPEMHSDNFPPLTLLLNHNFWQRHQGCIEIPDTTY

SEQ ID NO: 211 - protein, 88 aa, Chlamydia pneumoniae
  CPn0209
NSSNNIRLKMETYSFSTELQKNTSLYIMEKLDSYFSFQGKRTRVIAITPAGLAIAYEQNIHLSMTVKILKVLSFPRSLLRTTSLWYRP

SEQ ID NO: 212 - protein, 340 aa, Chlamydia pneumoniae
  CPn0210
YQKLWEREREYFKTIREKEHATISTMLVELEALKREFAHLKDQKPTSDQEITSLYQCLDHLEFVLLGLGQDKFLKATEDEDVLFESQKAIDAWNALLTKARDVLGLGDIGAIYQTIEFLGAYLSKVNRRAFCIASEIHFLKTAIRDLNAYYLLDFRWPLCKIEEFVDWGNDCVEIAKRKLCTFEKETKELNESLLREEHAMEKCSIQDLQRKLSDIIIELHDVSLFCFSKTPSQEEYQKDCLYQSRLRYLLLLYEYTLLCKTSTDFQEQARAKEEFIREKFSLLELEKGIKQTKELEFAIAKSKLERGCLVMRKYEAAAKHSLDSMFEEETVKSPRKDTE

SEQ ID NO: 213 - protein, 101 aa, Chlamydia pneumoniae
  CPn0211
ECVMSYPDISNVQASSIQSALLHKTSDQIQQKRCFKQSTFVILAVSLVIIGSLFLLAGVAILTVFSHGVLSLVFGVLGIVLGLLLLAGGVGLLVEEAKSLL

SEQ ID NO: 214 - protein, 398 aa, Chlamydia pneumoniae
  CPn0212
ELSYGVVVSIYSEILSFSELTSCKHSLFPFGPIETASIRIHHVFNVVIVCLIILGTLFVCLGMVFLGVFSTYLLGMSSMILGLLLISIGLALLKFKERYGLEPKELFGVEGGFDKKLPSEIIQMQDQIADLARELDLEQKKDTLIRGFSARLDVLEGSKTEKKQILKIGVPRNLSEIQERAQEQNSILEQCKEALLFRRKSAQEIFKKLYDRKAAFWRSYREDLWCYSEIHVSKKALSNLYIGDVFEGTAPHFLMEAYAMCRTAKNLRNYVKVCVEDMRVNEEKKRAKQLSVSELLCCCTEIETDLENETNLFTSDSEDVLEEYQIHCIRVTMLHALWAIYNDEVVSRKPIDTLDRVRARMAVEDCIETFEELQMCVVHTKTLELEIAQLYVDILLEA

SEQ ID NO: 215 - protein, 52 aa, Chlamydia pneumoniae
  CPn0213
ILVVFSRVIFSNTNQIGIPRLELILPLWKKENDPFCFLFSRVEGTFIILNIK

SEQ ID NO: 216 - protein, 441 aa, Chlamydia pneumoniae
  CPn0214
FLGLKEDYERPTYCNIPPAPHPQRVDSKGCIASHVSTVVVVALFILGIFFLSGSLAFLVHTSCGVLLGAALPILCIGLVLLAVALIVFLCHKHKTRQDLDYYDQDLDSLVIHKKEIPNDISELRVTFEKLQNLFQFHTKDFSDLSQELQGKFINCMEKWLTLEDEVTKFLIVRDRFLETRRNFTTFGEQVKGIQSNIFDLHEEKSSLYLELYRLRKDLQVLLNFFLLPPGILKVDYDEIEAIKGLFIRLTSRLDKLDVKAQERKKFINEMSREFKEVEKAFDIVDRATKKLMDRAKKESPARLFMGRTESLLEMKKNEEALKNQGLDPENLSHPELFSPYQQLLILNYLNSEIVLHHYEFLISGTVTSGLTLEECENRMRAASTGLNALLVRKLQFRGAIKSAYFEKLTEIEKELRSLQDVIKSLELELIHKIKDIVTEET

SEQ ID NO: 217 - protein, 427 aa, Chlamydia pneumoniae
  CPn0215
LTSSKKQVMSSAIARDCFPSPSPQPSSTLGVHPPKYKSLILSVSLIVLGVLLLCVGMLLLVNAIFSFSVLTVGLGGAGVFLGSLLLILGLIFFVSYHRKLSEATRSLEQKITLEYQPWADLRKELNEVQEWSNFLLDEWEDFKEVVAQHKSQFATFEGDLLLFGREVEKYETIWKELDGRDVALLTELKNIWGPLEFLRKKGDRLQCEIDKLRKEVMKVGKSGLKLACELTKFKSALKDVKIEQECYRDKRKVEKLEVFPEGYRRELLEVLKTRLSVEKEIQLFEEVVSAFEEKLASLHRTVFSEEELQEALDKAKAELLDIQVRKSVVEDLSCEPTLIQYHLLRLYEVQCRIVEQFLTQTFSSEQEKVLEEYEALKARIRKTLRVKLDQVRANVAFVASTTDLLSESESLDGNDSVFEDAHDDFLD

SEQ ID NO: 218 - protein, 150 aa, Chlamydia pneumoniae
  CPn0216
NKARTMNPVTFDRIQVDFIPEDTSLRINSYIVAGGLLILGVVLSILSVICLDIGLVGLSAGAAFTLGLGCLIFALFLFSFSLILLLSQEKRVPDVLSLYLEKEVPQYETPLYKEDLESERDMSAISERLGIIEEKLRIAEKFRYSDSVFV

SEQ ID NO: 219 - protein, 233 aa, Chlamydia pneumoniae
  CPn0217
PKCCKLKGFLSVNELIFGFQTFSVVVLGVFFASRGKAWLTGWLSLLSSIMNVFVLKQIHLWGFEVTSADVYVIGLLTCLNYAREHYEKNDINDAMLCSWVISIAFLVLTQLHLFLIPSPNDSSQEHFLALFSSTPRIVVASLVTLIFVQIVDIKLFTFLQRVFSKKYFAMRSTISLLFSQLIDTIIFSFLGLYGLVSNLCDVMIFAMLVKGIVITLAIPTLTVTKAVLDRRSS

SEQ ID NO: 220 - protein, 161 aa, Chlamydia pneumoniae
  CPn0218
IFLSKKVFFESYEDFANVASSWPKSLRALVQGRYFVDSELKETPYRIHDFKKTPIHHRLYRSLPIISTIGGIIRLIEAHSGPIHPRDKMKYRFEVLQAVIEILGLGVLILVFDIIGCFLAFLVAIILSLLLYCNSTFTCVQNLSFTERMLEGIGEAVNFLA

SEQ ID NO: 221 - protein, 375 aa, Chlamydia pneumoniae
  CPn0219
GSSLALKFHLIHQSKKSQARVGQIETSHGVIDTPAFVPVATHGALKGVIDHSDIPLLFCNTYHLLLHPGPEAVAKLGGLHQFMGRQAPIITDSGGFQIFSLAYGSVAEEIKSCGKKKGMSSLVKITDEGAWFKSYRDGRKLFLSPELSVQAQKDLGADIIIPLDELLPFHTDQEYFLTSCSRTYVWEKRSLEYHRKDPRHQSMYGVIHGGLDPEQRRIGVRFVEDEPFDGSAIGGSLGRNLQEMSEVVKITTSFLSKERPVHLLGIGDLPSIYAMVGFGIDSFDSSYPTKAARHGLILSKAGPIKIGQQKYSQDSSTIDPSCSCLTCLSGISRAYLRHLFKVREPNAAIWASIHNLHHMQQVMKEIREAILKDEI

SEQ ID NO: 222 - protein, 193 aa, Chlamydia pneumoniae
  CPn0220
FYSFLKKKGIFYMSKESIRSYSEISTPTPIFRETPSKEGVAYKLQLRSPAKDCILRNRVSLKGALLRSIPFYGSFLGAKRIHSAWSAKDAPCTTRVYHYLVGGLELLGLGVVVLACKVLATALKFLFSKASSKIKQMKWREKARNLAAKDTVQSIKEFCSVDLTSCFTRCFRLRNRVVEEGASENQTVREIIV

SEQ ID NO: 223 - protein, 148 aa, Chlamydia pneumoniae
  CPn0221
DALRYKYEIGIQMVNRYKSSAEFSADHYYDDNLVRMGYKRNLRGLAPVENEVCLFEENNLLESVMASIPIMGSILGLGRLHSVWSTQDPKDSKISIIFHTALGILETLGLGIIVLLIKITITILLILFTPCLLCYFMYSAAYSDFHPI

SEQ ID NO: 224 - protein, 123 aa, Chlamydia pneumoniae
  CPn0222
GEKFLKPWEKLRELNAFELTQPEEYRNRWVLMPCLKCRFCRTQHAKVWSYRCVHEASLYEKNCFLTLTYDDKHLPQYGSLVKLHLQLFLKRLRKMISPHKIRYFECGAYGTKLQRPHYHLLLS

SEQ ID NO: 225 - protein, 128 aa, Chlamydia pneumoniae
  CPn0223
STMLIGRYSSDDQFTEATKNTPTIIKLGFVRDNLEGLTNPISEIVSETSSSIKDSVLRSLPILGSILGCARLYSTLSTNDPLDETQEKIWHTIFGALETLGLGILILLFKIIFVILHCIFHLVIGFCK

SEQ ID NO: 226 - protein, 91 aa, Chlamydia pneumoniae
  CPn0224
YTFKNPKKNKKMKPNSIIFLENTKHYPDIFREGFVRDRHGLMEASDWLLSTEITIIRSILGAIPILGNILGAGRLYSVWYTSDEDWKKQVV

SEQ ID NO: 227 - protein, 232 aa, Chlamydia pneumoniae
  CPn0225
NSFTIKFLLMTKNAINSQTTTPQPNLTDAEPIASRAQCKSIAVIISLFALGMLLLCLGIILISIPIPGLAAQVALGLGIVSLILGIALANIGFLCLLLRCKQVPQKPDTLPSESSKQPSEGSTPTALPWQAGEFLEKVQVSATPILLPKNKDEELSAKVMKEGAEAASSIKQAVLESTEKLIDARKQEESRREARKKIVAEEAEASRKRIQQQMAADQEALRKRKEEVAKRK

SEQ ID NO: 228 - protein, 141 aa, Chlamydia pneumoniae
  CPn0226
AIFNRKRMPYYANTLEFIQGTQSLCPLFKYGFVRHHYKGQLEIEDASHDWDFLEPPSTWKRTLLAAIPILGSVIGLGRLFSIWSIREPQDSQEYKSIFWHTLCAVLEILGLGIVALILKILATFIMAMPGLKRVATFLFYS

SEQ ID NO: 229 - protein, 153 aa, Chlamydia pneumoniae
  CPn0227
KERFNIFVSCKLLKEIMMINFIRSYALYFAWAISCAGTLISIFYSYILNVEPCILCYYQRICLFPLTVILGISAYREDSSIKLYILPQAVLGLGISIYQVFLQEIPGMQLDICGRVSCSTKIFLFSYVTIPMASVVAFGAIVCLLVLTKKYRG

SEQ ID NO: 230 - protein, 277 aa, Chlamydia pneumoniae
  CPn0228
VKDRADFLNLKEKFSCSILKKENAFEFYVFCSIKQLTNSSLRGPLNKKILVLCTAMFFIVCFGFLIHKKHTILPPKAHIPTNAKHFPTIGNPYAPINITVFEEPSCSACAEFTTEVFPLLKKHYIDTGEISFTLIPVCFIRGSKPAAQALLCIYHHDPRQADIDAYMEYFHRILTYPKEEGSHWATPEVLTKLAEGLKINSGRSVNPKGLEQCIASGQYNEQIKKNNLYGSQVLGGQLATPTAVVGDYLIEDPTFHEIERAIQHIRQLQAVEGDHDD

SEQ ID NO: 231 - protein, 466 aa, Chlamydia pneumoniae
  CPn0229
NSKAFSFLRIEQENFSFKFKKSALSFTYNTANLTKSTFTFILLLLLRKKDQGLRFMDKETLENIYRHFRYRFLKLNILPAFLGLLLLCSPNTLNYTQVDVIFSDRLCSCLLIFLAIASLTKRSLLWLGAPLGIWVTLFACVAGRSPTIFANDTLIGFAILAVVCISPTRPEALEVGPTLPEGFSYNPSAGGRRAAVLFLSLLGWLEARYLTASSLGITSSQSSNFLLLYSSIMTVYSLLVVLSLAGSERRWHTRPKIVIATALALTGVIILTLLPIILHQLRYDCWLCLCLTIEPALAVVFAYDETRATLRYISQFLGDKRALTRASFFGSEYYKHTLSWEERTVLPLRKAYKQAFEGISFPINQLLAILVATVFVKVNSSMGLPTFPRNFLNICCWFIIVLFILAFAESLRHLRWMNLIFSAAILFSPVLFHIPVESPMFLPIIVTGLILIILSIGKRRRTKRKL

SEQ ID NO: 232 - protein, 234 aa, Chlamydia pneumoniae
  CPn0230
RFKKALIYMSSQPLVTTSSSLSRYVVLTGEEKVACYKKAFNHIWHGAPAIILAAALLMFCIFGFVLGSILLGAPLEGASILYDVILPWLLPSILVFVLLVLPLNIYAYSHHKQVLALHERITQSNYKEIYDHCEKEKKTPNKKALSLYIESQVLVPEYSKRFSSMILGKTLKIIPKKDSPESLKHDELIQKALERAKENIYMNKNQREKRDEREAKKEAKNASKTNPLWEGLGT

SEQ ID NO: 233 - protein, 248 aa, Chlamydia pneumoniae
  CPn0231
PQAFVSIQDRGFSMLQAHRLCYSCDNQVILKDASFQASPGTITIILGSSGVGKTTLFRLLAGFLPLQEGELLWNGSPLNRKDVAYMQQKEALLPWRTALKNMTLSTELGINTSHNALSNERLEEIIHNFDLGQLLDRYPDELSGGQRQRIALAAQCLSLKPILLLDEPFSSLDVLLKEQLYQDIVALAKKENKTVLLVTHDFHDVSCLGDVLYVIKNKTLTPVPLDPSMRPLNNGLCFIKDLKKHLYT

SEQ ID NO: 234 - protein, 301 aa, Chlamydia pneumoniae
  CPn0232
KKFLMRRFLFLILSSLPLVAFSADNFTILEEKQSPLSRVSIIFALPGVTPVSFDGNCPIPWFSHSKKTLEGQRIYYSGDSFGKYFVVSALWPNKVSSAVVACNMILKHRVDLILIIGSCYSRSQDSRFGSVLVSKGYINYDADVRPFFERFEIPDIKKSVFATSEVHREAILRGGEEFISTHKQEIEELLKTHGYLKSTTKTEHTLMEGLVATGESFAMSRNYFLSLQKLYPEIHGFDSVSGAVSQVCYEYSIPCLGVNILLPHPLESRSNEDWKHLQSEASKIYMDTLLKSVLKELCSSH

SEQ ID NO: 235 - protein, 64 aa, Chlamydia pneumoniae
  CPn0233
EKARTMFLGKVLLFLLRISRRSYVQEIGIFFHLETPDLKIVLCAFVSTFIVVEMDVSLKNKGQS

SEQ ID NO: 236 - protein, 233 aa, Chlamydia pneumoniae
  CPn0234
FIMLQSCKKALLSIVVSILAFHPIPGMGVEAKSGFLGKVKGWFSKKEIQEEARILPVKDSLSWKRYDYTSSSGFSVEFPGEPDHSGQIVEVPQSEITIRYDTYVTETHPDNTVYVVSVWEYPEKVDISRPELNLQEGFSGMMQALPESQVLFMQARQIQGHKALEFWIVCEDVYFRGMLISVNHTLYQVFMVYKNKNPQALDKEYEAFSQSFKITKIREPRTIPSSVKKKVSL

SEQ ID NO: 237 - protein, 261 aa, Chlamydia pneumoniae
  CPn0235
VFVRYLLMKPEESECLCIGVLPARWNSSRYPGKPLAKIHGKSLIQRTYENASQSSLLDKIVVATDDQHIIDHVTDFGGYAVMTSPTCSNGTERTGEVARKYFPKAEIIVNIQGDEPCLNSEVVDALVQKLRSSPEAELVTPVALTTDREEILTEKKVKCVFDSEGRALYFSRSPIPFILKKATPVYLHIGVYAFKREALFRYLQHSSTPLSDAEDLEQLRFLEHGGKIHVCIVDAKSPSVDYPEDIAKVEQYITCLSNAYF

SEQ ID NO: 238 - protein, 543 aa, Chlamydia pneumoniae
  CPn0236
SRTIYHMPFKCIFLTGGVVSSLGKGLTAASLALILERQRLNVAMLKLDPYLNVDPGTMNPFEHGEIYVTDDGVETDLDLGHYHRFSSAALSRHSSATSGQIYARVIKREREGDYLGSTVQVIPHITNEIIQVILDAAKEHSPDVLIVEIGGTIGDIESLPFLEAIRQFRYDHSEDCLNIHMTYVPYLQAADEVKSKPTQHSVQTLRGIGIIPDAILCRSEKPLTQEVKSKISLFCNVPNRAVFNVIDVKHTIYEMPLMLAQEKIANFIGEKLKLATVPENLDDWKVLVNQLSQDLPKVKIGVVGKYVQHRDAYKSIFEALTHAALRLGHAAEIIPIDAEDENLTMELSQCDACLVPGGFGVRGWEGKIAAAKFCREQGIPYFGICLGMQVLVVEYARNVLNLDQANSLEMDPNTPHPIVYVMEGQDPLVATGGTMRLGAYPCLLKPGSKAHKAYNESSLIQERHRHRYEVNPDYIQSLEDHGLRIVGTCPPQGLCEIIEVSDHPWMIGVQFHPEFVSKLISPHPLFIAFIEAALVYSKDASHV

SEQ ID NO: 239 - protein, 158 aa, Chlamydia pneumoniae
  CPn0237
SILRMQAMSKPSSCKAYLGIDYGKKRIGLAYAAEPLLLTLPIGNIEAGKNLKLSAEALHKIILSRNITCVVLGNPLPMQKGLYSSLQEEVSLLAEELKKLSTVEIILWDERLSSVQAERMLKQDCGLSRKDRKGKTDSLAATLILTSFLDSLPKKLTL

SEQ ID NO: 240 - protein, 543 aa, Chlamydia pneumoniae
  CPn0238
PCNHQKLRDFNFRNFLLFVIFASAGTKKEIKMTNVVQETIGGLNSPRTCPPCILVIFGATGDLTARKLLPALYHLTKEGRLSDQFVCVGFARREKSNELFRQEMKQAVIQFSPSELDIKVWEDFQQRLFYHRSEFDNNMGYTSLKDSLEDLDKTYGTRGNRLFYLSTPPQYFSRIIENLNKHKLFYKNQDQGKPWSRVIIEKPFGRDLDSAKQLQQCINENLNENSVYHIDHYLGKETVQNILTTRFANTIFESCWNSQYIDHVQISLSETIGIGSRGNFFEKSGMLRDMVQNHMMQLLCLLTMEPPTTFDADEIRKEKIKILQRISPFSEGSSIVRGQYGPGTVQGVSVLGYREEENVDKDSRVETYVALKTVINNPRWLGVPFYLRAGKRLAKKSTDISIIFKKSPYNLFAAEECSRCPIENDLLIIRIQPDEGVALKFNCKVPGTNNIVRPVKMDFRYDSYFQTTTPEAYERLLCDCIIGDRTLFTGGDEVMASWKLFTPVLEEWDQDSSPSFPNYPAGSSGPKEADALIERDGRSWRPL

SEQ ID NO: 241 - protein, 270 aa, Chlamydia pneumoniae
  CPn0239
KSISMTNIGIETMATLINFNDTNKLLLTKQPSLFIDLASKDWIASANQAIKQRGAFYVALSGGKTPLEIYKDIVINKDKLIDPSKIFLFWGDERLAPITSSESNYGQAMSILRDLNIPDEQIFRMETENPDGAKKYQELIENKIPDASFDMIMLGLGEDGHTLSLFSNTSALEEENDLVVFNSVPHLETERMTLTFPCVHKGKHVVVYVQGENKKPILKSVFFSEGREEKLYPIERVGRDRSPLFWIISPESYDIADFDNISSIYKMDIL

SEQ ID NO: 242 - protein, 388 aa, Chlamydia pneumoniae
  CPn0240
LVYFMVFSPSSESVVKANSVVRSNFCYFLENKFVSPSESTEVMFSEIMKGRVPDIESLFDRPTDMMMTGFKAAQNLGNLFNSFGILIMCFSQCKSCQTPEKETSAIVLGATLLFFVVALILGPTLGALVYCAYKVYTLGKMIYSLNKAKAKVLRHPAQNVFHRAAGVATIRSSEEAVKACKLYKSAMIGSLVVSLIASLALIALTAGIVLVLFFVAPGAAPVITAAMMGCCAAGGGALLISLLGLWIAIVRKAKHQEACVGHLTNVVLHTAVSEALLHDPSHFQTNALARDLFLTDCLSHYGHLFSNEEVAQLVQGGAPGGGSRPSQHYGGSSDYQNRRGGNGNFGGSHFGGGGGFAGSHFGAGYPTAPTMPSAPPPFPPPAYDTIYG

SEQ ID NO: 243 - protein, 390 aa, Chlamydia pneumoniae
  CPn0241
IFLVKFMSAMISLSSSHEASIASNTQVRDVLVSLAMDEFVEHNTEILPIKVFLARGTLSSTAIIDDLKDVVETEGEHHFQVYSNISLKMIYQRFFEKIFGIGCCPLLLVTDSHHTDPCGALITGIFAAVLFTVLAIVFGPTLGILCYSAYKIYQLTKKISSLSRTHTEVINSVQKSDPFIHRSGAVAAAAASQSTIKACKVFRQSTLIFFVLGLIITISLAALIVGLVFALFFLDPGAPAVMTAAMIGCCAAGGTGILLSVIGFLLASVYSVQKSQEGVHHMHTALLRCIVSNTIIQMPYLPITPGTKKVLTQSIRRYQQFFSDDEYRDIESEVPLNRQTTPPPSYETLFHEEGSDGSSNVIPRESPPAYSTIDSSNSPFPSSSPPPYYR

SEQ ID NO: 244 - protein, 163 aa, Chlamydia pneumoniae
  CPn0242
KSLKYCSLYQFSQKPTVILMACSIFFRMSQGDYDDEPLSKKTACLVVDTMLYPVIAVVCAVVSVVLLILKVLFLLLSFPFKLCSASSALPGERVSLGSHFKCLYGGGLPYLLACLLIVPVIGTAIHGFIISHRTSEDARLSSAIVFMQAPILQLAGMSGLIKP

SEQ ID NO: 245 - protein, 159 aa, Chlamydia pneumoniae
  CPn0243
INYNYLVFLLKFVKGRIIMACSIGYHLCNANEPDRFVASKVALVADILLYPFMAVICAVVFAVLMVVKLLFLAIKFLVNTCIAACKSRPLPSCKENFQCLFGPKDKPGPSDWLGCLVLIPIIGTLIYSTIITVQSDTNRLRYFIISPAYQVGSTAIINW

SEQ ID NO: 246 - protein, 217 aa, Chlamydia pneumoniae
  CPn0244
GAFEVTKGSVFIIMGPPGSGKGTQSQYLANRIGLPHISTGDLLRAIIREGTPNGLKAKAYLDKGAFVPSDFVWEILKEKLQSQACSKGCIIDGFPRTLDQAHLLDSFLMDVHSNYTVIFLEISEDEILKRVCSRFLCPSCSRIYNTSQGHTECPDCHVPLIRRSDDTPEIIKERLTKYQERTAPVIAYYDSLGKLCRVSSENKEDLVFEDILKCIYK

SEQ ID NO: 247 - protein, 291 aa, Chlamydia pneumoniae
  CPn0245
TCQKEIMKHYLSFSPSADFFSKQGAIETQVLFGERVLVKGSTCYAYSQLFHNELLWKPYPGHSFRSTLVPCTPEFHIHPNVSVVSVDAFLDPWGIPLPFGTLLHVNSQNTVIFPKDILNHMNTIWGSGTPQCDPRHLRRLNYNFFAELLIKDADLLLNFPYVWGGRSVHESLEKPGVDCSGFINILYQAQGYNVPRNAADQYADCHWISSFENLPSGGLIFLYPKEEKRISHVMLKQDSSTLIHASGGGKKVEYFILEQDGKFLDSTYLFFRNNQRGRAFFGIPRKRKAFL

SEQ ID NO: 248 - protein, 135 aa, Chlamydia pneumoniae
  CPn0246
VVAKSTIQESVATGRRKQAVSSVRLRPGSGKIDVNGKSFEDYFPLEIQRTTILSPLKKITEDQSQYDLIIRVSGGGIQGQVIATRLGLARALLKENEENRQDLKSCGFLTRDPRKKERKKYGHKKARKSFQFSKR

SEQ ID NO: 249 - protein, 154 aa, Chlamydia pneumoniae
  CPn0247
DSYIIMEKRKDTKTTIVKSSETTKSWYVVDAAGKTLGRLSSEVAKILRGKHKVTYTPHVAMGDGVIVINAEKVRLTGAKKGQKIYRYYTGYISGMREIPFENMMARKPNYIIEHAIKGMMPRTRLGKKQLKSLRIVKGDSYETFESQKPILLDI

SEQ ID NO: 250 - protein, 268 aa, Chlamydia pneumoniae
  CPn0248
RSPPGYLESRVRYATFSRSFRSPACKKSRKNACLRNFKSRLAMSLLIEAKNLSKTIQQQNQNISILTDVSLSLHAGETISITGASGNGKTTLLHLLGTLDVPSSGSLRFFDKDLKNQDLANFRNQHIGFVFQNFYLLEDDTVLKNVLMPALIARKNISKGSPVYTRALELLDLVNLEDKVRTRCSKLSGGEKQRVAIARALINEPAILLADEPSGNLDEETSEQIHNLLLEQASALCGILIVTHNKHLASRCSREGVLSNGKLFFHNS

SEQ ID NO: 251 - protein, 506 aa, Chlamydia pneumoniae
  CPn0249
LEVMKFEFSVALKYLIPGRGRLYSAIVSLFSVGIISLVVWLSIVFISVIHGLEQRWIEDLSQLHSPITILPSDTYYSSYYYQIDKHSSLSNYTTKTLGEKIASPQVDPYDPESDYLLPETFPLKDCDLGGQQKDPVKMTLESLGPYLQSQHGKVIEFEQGVGYLDIKTSLKLQKPQPRNLTHFLTYPSKLSYEDKVLPYDETDYTSAELNPFNRSPSGWQQDFHHLEELYRGASIILPSTYKDSGYKVGDTGVFSTYSIENEKETQYTVHVIGFYNPGLSPLGGRTVFIDPDLARSIRSQSEGLGMSNGFHLFFPNTKRIVFVKKQIENILTSLGVDDYWEISSLHDYDYFQPILDQLQSDQVLFLFVCILILIVACSNIVTMSMLLVNNKKKEIGILKAMGTSSRSLKIIFACCGAFSGACGVVIGTIFAIITLKNLQFIVKALNYLQGRETFNTAFFGQNLPNSVHPQAIYFLGLGTLLLAAVSGALPARKVAKMHVSEILKAD

SEQ ID NO: 252 - protein, 56 aa, Chlamydia pneumoniae
  CPn0250
KDSSMASKNREIIKLKSSESSDMYWTVKNKRKTTGRLELKKYDRKLRRHVIFKEAR

SEQ ID NO: 253 - protein, 508 aa, Chlamydia pneumoniae
  CPn0251
SPDSCLPWMSPFKKIVNRLLCYISFQKESRTLPIIIREPRMTTKSLGSFNSVISKNKIHFISLGCSRNLVDSEVMLGILLKAGYESTNEIEDADYLILNTCAFLKSARDEAKDYLDHLIDVKKENAKIIVTGCMTSNHKDELKPWMSHIHYLLGSGDVENILSAIESRESGEKISAKSYIEMGEVPRQLSTPKHYAYLKVAEGCRKRCAFCIIPSIKGKLRSKPLDQILKEFRILVNKSVKEIILIAQDLGDYGKDLSTDRSSQLESLLHELLKEPGDYWLRMLYLYPDEVSDGIIDLMQSNPKLLPYVDIPLQHINDRILKQMRRTTSREQILGFLEKLRAKVPQVYIRSSVIVGFPGETQEEFQELADFIGEGWIDNLGIFLYSQEANTPAAELPDQIPEKVKESRLKILSQIQKRNVDKHNQKLIGEKIEAVIDNYHPETNLLLTARFYGQAPEVDPCIIVNEAKLVSHFGERCFIEITGTAGYDLVGRVVKKSQNQALLKTSKA

SEQ ID NO: 254 - protein, 179 aa, Chlamydia pneumoniae
  CPn0252
ATSTVCALWILQTYQSHDDAASCSFRRACRFGRYWLGGVNVPWNKFNQTSTQSTVINSAIYIDSSQTWMMRFQASASIPRLFRISIFMTKHGDWIDNGTGGELLLVAYEANQNPLFPDIRIELAMSTCSGTSYYRARPMQWLCSTYYAVRPGYFVLENRSYSFRVQSFSWNIATLPFVN

SEQ ID NO: 255 - protein, 175 aa, Chlamydia pneumoniae
  CPn0253
FCGGRLMSSSIPTTQKITISIPTFVRFNIESINLTDEQKKTALTIGQNIATENTQVLGNFVDADGGLICQNDLSVGGNINITPQTFNTMVFSGRVNLSNSPFSYQDSLGNKRQDYANINTEQPQQYVPYGYYKLTRVMMMQRAALSGGHVGSGDIGWGESMYLGISSIKRQHKVQ

SEQ ID NO: 256 - protein, 270 aa, Chlamydia pneumoniae
  CPn0254
IPMKTLGVKDQNLFIDQATLSVERNVRIENNLETRDLKVLDTTTSPCEFIVKGNVSAEGSQLNATTLSDGFNIYSKTDVSQTPVCNNISDPQSARDALTFSYYRKTGCQAANLYTYYPGNGYYVAPNTTIETHVAAITSKSVSRNATPDFSRYADIEPVVKLKQVGIYQVTMQLTRWSGQHDGDNSATLILNFVSGNNKTLLCTSDTRGGYSSDRTSVAVTAIFSVTELVSSPPYDYPWINLESTIWMNLMSLSTCVIWFPFPSNFVEVD

SEQ ID NO: 257 - protein, 285 aa, Chlamydia pneumoniae
  CPn0255
TLLKVIMKNNINNNECYFKLDSTVDGDLLAANLKTFDTQAQGISSTETFSVQGNATFKDQVSATGLTSGTTYNLNAQNFTSSQISIDFKNNRLSNCALPKEDCDPVPANYVRSPEYFFCSKPLIGDFDFNSGESYLPLTGSEYTLYQSRNVNSIFRFIGWKQSTRELTVGGNTAIQFLAAGTYIVSFTVGKRWGWNNGWGGAIYINNGLGQVQCESTIYSGGGYATIGTLGTSIYRASVDVAPNPNDPNASDRYRAGIFYLSNGGSSAGIGNYSFSLLYYPDDRG

SEQ ID NO: 258 - protein, 295 aa, Chlamydia pneumoniae
  CPn0256
FCGGRLMSNPTPKTKISIPTFVRFNIQSINLTEDQKKTTFTVGGKVTTENTVVRGDLTCTDGGLTCQSDLTIQKDINIRPTSTNSMVFDGRLNLSNSPLSYKNSQGQDITDYEKMSSGKPQEYVPFGYYKRTQIMMAQRAAHSSGYVGGGSVPSGSYVPWNKFDQTSTQKTSGTEIYIDPNDSTKLVFEVNNKVPKLFRISVIMAKHGSWLDNGTGADILLAANEYEQGGGRINVTDLAMTTSRGSSYYETRPLQVVCVTYYAQNNGYFTFQNRAGGGLRVSFFSWNIVALPYVE

SEQ ID NO: 259 - protein, 290 aa, Chlamydia pneumoniae
  CPn0257
GVVMKRRNLQKILPNASTPSTNVAENTGIKDQNLFLDQATLNVDGNVDIENFLETRDLKVADTITSPCEFTVGGGLSAESSQFKATTLSKGLEITSEDQDGRVPKFTNVSDPQSPRDALTYNYYRNTGCQALNLYTYYSSSQPTTVGKPIETVCQNPNPETYRISASAKIYDAVTRFPYIQFKAPGIYQVTIQIRRESGQHSGLDNPNLYLNLMIGNNKTLLCASDTRGYSGGHRTSIAVTGTFTLTEIVATPPHDYPWLFLETTIGLDIKSMSTCVIWFPFQANFAEVD

SEQ ID NO: 260 - protein, 134 aa, Chlamydia pneumoniae
  CPn0258
CFSFCRLGSKFEKITLGGNTAIQLLAAGTYILTFTIGKRWGWNNGWGGSIRLFEGKYTGDGTMLCGSTVYSGGGYSTIGYLSTAVYRDHSDIDPDPNNPSDKYMNNFLFVRNGDHSAVIGNYSFTLLYFAGDKV

SEQ ID NO: 261 - protein, 197 aa, Chlamydia pneumoniae
  CPn0259
IYFVFKRKTYNYFIEMTTTNNQDNNECYFKLDSTVDGDLLASNIQTFDKQAKGISSTETFSVQGNATFKEKVSATGLTSASTYKLNATGPAPSSITIDMKNNRLSNPALPKNPCDPVPANYVRSPQYFFCAKPIEGTFMFDGSSRYLPITGDGSNYTLYQSSKAGDVFRFVDWDQNSKKLHLGGTQPYNFLLQEPIS

SEQ ID NO: 262 - protein, 181 aa, Chlamydia pneumoniae
  CPn0260
AYLDFSKRSCVEEDHVSKKINRNDLCPCGSNKKYKQCCLKKEEQTARYTTEGKFKFSAEVLSASEQGEAGDNCTKLFQRLSQSLTSEQKAAVGKFHQITKNKEVMSKKALKKAQAKEEKLVTEKLQQHNFEILNTGENLAPPMESTATLNQDTNFVCEDFIPTQEDFRISENSQKPPVEED

SEQ ID NO: 263 - protein, 254 aa, Chlamydia pneumoniae
  CPn0261
YSFNHPFIVFMSTLLLNPPWMKAGKRIESLVRKALYTHTMLANHRKIVVALSGGKDSLTLLLMLKAISGRGFPDLDLHAVNIGGKYSCGAEVNKPYLTRICDQLCIPFRTIPSPYAPETPECYPCSQARRRLLFQAAKEIGASAIAFGHHRDDLVQTALLNLLHKAEFAGMLPVLDMVHFGVTILRPLIFTPEFWIRKFAKENGFARVTCRCPVVSLRSKAEQSLKLLEEVFPLARHNIALAIQEHGSSKSQKI

SEQ ID NO: 264 - protein, 293 aa, Chlamydia pneumoniae
  CPn0262
LIFNINKEVKVYLVLMNKRLKIILTNDDGITAKGMSCLVSALLEANIGDIYIAAPQAEQSGKSMAISLNQVVCASPYAYPQPVKEAWAVGGSPTDCVRLGLRTLFESVSPDLVISGINCGNNICKNAWYSGTIGAAKQALVDGIPSMALSQDNHISFFQQDKAPEILKALVIYLLSQPFPCLTGLNINFPTSPGGSSWEGMRLVPPGDEFFYEEPQYLGSVNKNQYYVGKISGVRIGEHPSEELACMLENHISVSPIFSQNSPIGLMTLEEFQKTQENFNASLLSSELTTKIF

SEQ ID NO: 265 - protein, 321 aa, Chlamydia pneumoniae
  CPn0263
STALSRRKLRVRPPSLAKYAFRGFRMSHGPRPTKFSFPLYFSKTLSWFILGGFLAACGVQMVLVPNELIDGGIVGLSIIASHFLGHKALPFCLVLFNLPFVFLAFKQIGKYFVIQMLTAVIIFSCSLWLIDQLPSWLGMSPFVFKGSEMETVVLGGAIIGVGCGLIIRHGGSTDGTEILGIIINKKKGYTVGQIILFVNFFIFALSGIVYKNWHTAFVSFLTYGIATKVMDMVILGLEDTKSVTIITSSPRKLGHILMETLGIGLTYIHAEGGYSGEPRNLLYVVVERLQLSQLKEIVHREDPSAFIAIENLHEVINGRRT

SEQ ID NO: 266 - protein, 192 aa, Chlamydia pneumoniae
  CPn0264
MKRYVVGISGASGVILAVKLIKELVNAKHQVEVIISPSGRKTLYYELGCQSFDALFSEENLEYIHTHSIQAIESSLASGSCPVEATIIIPCSMTTVAAISIGLADNLLRRVADVALKERRPLILVPRETPLHTIHLENLLKLSKSGATIFPPMPMWYFKPQSVEDLENALVGKILAYLNIPSDLTKQWSNPE

SEQ ID NO: 267 - protein, 301 aa, Chlamydia pneumoniae
  CPn0265
KIIIVRLNYFLNLVNFKYSIFSILFLSASTVFALSINEISQNLSFKEGFKISVFGAIAFVFARTTGIVVNQCIDRFIDKKNTRTSKRVLPANLVSLNFAWVLSLFCSFLFLFLCKILRIFSLGIASLTLMIVYPYMKRVTFFCHWGLGLVYTVAILMNFCAFAESGLSMRLCFLALLWGGSVGMVIAANDIIYAIEDTEFDREEGLRSVPAHYGEKKAVEIAKVNLWVSYLAYIFSGFVGSLDKEFYFTAIIPLVVILKVVRMYSNYSKKDQEGESKFFLANIAIALSFLVSMTLFWSLSR

SEQ ID NO: 268 - protein, 232 aa, Chlamydia pneumoniae
  CPn0266
IMALDEINNQNNPSQQIASSTSQTSKINQDRKTFACTVTLLVVATLMILSGIVLLFTIGSLGLSVPLSGILGTFAVTVGAVLFITGLTILVRKSLGIEQKNEDLNFLKIKTPTPPARPLMSKFSVTCSTTSIVLGMALLIGAVVSVFFLTGYLQLGLCAGLVGLGTALFVAGLARMSPRSLADQEGSGSADSQSNIVGIGEPKAAQEQKWYKMAVVRGEDGIPTAIRLTPEK

SEQ ID NO: 269 - protein, 263 aa, Chlamydia pneumoniae
  CPn0267
VSIMSLNKTNALLNQPEPAVCLNAWDPKYINQDRKTFACTVTLLVIATLMILTTGVIVLLAMGSPGLSVLVSTIIGTSVTTLGTALFIIGLVKLIKKSLAWIQYQKYFQEVVKQKYEPFSIPKNDNVHKLTSCLPSPLDIESPSPEASTPVSKLRIACSGVAIVLGVTLLIGAVVSVFFCTGYLQLALCVGFACLGTALFVGGLAGLRTHSLIAQGIMYLYLTYYLSSALEERNETVKDQRNEINTYLTEECRQQKREKALLE

SEQ ID NO: 270 - protein, 135 aa, Chlamydia pneumoniae
  CPn0268
KQWALSLMSQCQSSSTSTWEWMKSFVPNWKNPTPPLSPIPSEDEFILAYEPFVLPKTDPENAQANPPGTSTPNVENGIDDLNPLLGQPNEQNNANNPGTSGSNPTSLPAPERLPETEENSQEEEQGSQNNEDLIG

SEQ ID NO: 271 - protein, 331 aa, Chlamydia pneumoniae
  CPn0269
VAFRCVMTIDMHCDLLSHPHFCRKDPAVRCSPEQLLSGGVRQQVCAIFVPHSRGEPNCDKQNSLFFSLPNQYPDIGLLSYEEEENGSSSQKKSLSLIRSIENASALGDDTAPLGTLLAKLIHLTKQGPLAYLGIVWKGDNRFGGGTEAPKRLSNDGKVLLDIMYELGVPIDLSHCSDKLAEDILDYTADKLPNLAVIASHSNFRSVLDHRRNLVDAHAKEIVRRKGVIGLNLVRSYVGDSLGDLEKHVLHAENLGILSSIVLGSDFFYANEDENFFFNECSSAEAHPVLNQLIHRIFSKGKAESILSSRAEKFLKQVIVEQVNPKITDVKL

SEQ ID NO: 272 - protein, 292 aa, Chlamydia pneumoniae
  CPn0270
SIFGVIVPDKKAQITFSLPEVMSAIHQGKIVALPTDTVYGFVLSLYASEAEERLYALKDREPSKAFALYVNSIEDIENISGYPLSPTAKKLAQLFPGAITLVVKHRNPRFPKETLAFRIVDHSVVREIVDHCGTLIGTSANLSEFPSALTAQEIFADFADHDLCIFDGPCSHGLESTVVASDPLYIYREGLISRSVIENIAGTEAKIFHRTSHAFSKHIKIYTVKNQEQLVSFLSGSLDFKGVVCEHPKPKNFYTRLREALKKKTPSIVFIYDINTSDYPELFPFLSPYYIE

SEQ ID NO: 273 - protein, 245 aa, Chlamydia pneumoniae
  CPn0271
KLMTDYSFFRRKIGNIEAIECPGNPQDPIIILCHGYGSLADNLTFFPSICSFSKLRPTWIFPNGILPLENDFRGSRACFPLNVLLLQELSRLYANGVGNLQEKYDELFDVDLETPKEALEELILNLNRPYNEIIIGGFSQGAILATHLVLTSQNPYAGALIFAGARLFNQGWEEGLKQCAQVPFLQSHGYEDEILPYHLGAHLNDLLLTKLNGQFVSFHGGHEIPSVVFQKMQVTVPNWIDPARG

SEQ ID NO: 274 - protein, 311 aa, Chlamydia pneumoniae
  CPn0272
FNRQSDATYATWVMHLEEENQGWEALLRKVYHQEVPPAILLHGFTLPVLQDKAEQLASEILLSSSPGSEHKVSQKIHPDIYQFFPEGKGRLHSIDLPRGIKKQIYISPFEANYKIYIIHEADRMTLAAISAFLKVFEEPPKHAVIILTTAKVQRLPKTIISRSLSIFIERGEKILCSKETFSYLFRYAQCEIPVTEVSQIIKESSETDKQVLRDKVQRFMEVLLELYRDRYTLNLGLKASALNYPEHVKEILQLPLLPLDKVLLIVESACRSLNNSSSAASVLEWVAIQLVSLQYKEKELVSVSPGQDLSN

SEQ ID NO: 275 - protein, 209 aa, Chlamydia pneumoniae
  CPn0273
GSIVFIVIEGGEGSGKSSLAKALGDQLVAQDRKVLLTREPGGCLIGERLRDLILEPPHLELSRCCELFLFLGSRAQHIQEVIIPALRDGYIVICERFHDSTIVYQGIAEGLGADFVADLCSKVVGPTPFLPNFVLLLDIPADIGLQRKHRQKVFDKFEKKPLSYHNRIREGFLSLASADPSRYLVLDARESLASLIDKVMLHTQLGLCT

SEQ ID NO: 276 - protein, 839 aa, Chlamydia pneumoniae
  CPn0274
ESTIPMFNKDEIIVPKNLEEEMKESYLRYSMSVIISRALPDIRDGLKPSQRRVLYAMKQLSLSPGAKHRKCAKICGDTSGDYHPHGESVIYPTLVRMAQNWAMRYPLVDGQGNFGSIDGDPPAAMRYTEARLTHSAMYLMEDLDKDTVDIVPNYDETKHEPVVFPSKFPNLLCNGSSGIAVGMATNIPPHNLGELIEATLLLLANPQASVDEILQVMPGPDFPTGGIICGSEGIRSAYTTGRGKIKVRARLHVEENEDKHRESIIITEMPYNVNKSRLIEQIANLVNEKTLAGISDVRDESDKDGIRVVLEIKKGESSEIIINRLYKFTDVQVTFGANMLALDKNLPRTMSIHRMISAWIRHRKEVIRRRTRYELNKAETRAHVLEGYLKALSCLDALVKTIRESGNKEHAKERIIESFGFTEPQALAILELRLYQLTGLEAEKIQKEYEELLNKIAYYKQVLSDEGLVKDIIRNELQDLLKHHKVARRTTIEFDADDIRDIEDIITNESVIITISGDDYVKRMPVKVFKEQRRGGHGVTGFDMKKGAGFLKAVYSAFTKDYLLIFTNFGQCYWLKVWQLPEGERRAKGKPIINFLEGIRPGEELAAILNIKNFDNAGFLFLATKRGVVKKVSLDAFSNPRKKGIRALEIDEGDELIAACHIVSDEEKVMLFTHLGMAVRFPHEKVRPMGRTARGVRGVSLKNEEDKVVSCQIVTENQSVLIVCDQGFGKRSLVEDFRETNRGGVGVRSILINERNGNVLGAIPVTDHDSILLMSSQGQAIRINMQDVRVMGRSTQGVRLVHLKEGDALVSMEKLSSNENDDEVLSGSEEECSDTVSLR

SEQ ID NO: 277 - protein, 806 aa, Chlamydia pneumoniae
  CPn0275
FMDPKEKNYDASAITVLEGLQAVRERPGMYIGDTGITGLHHLVYEVVDNSIDEAMAGYCSRIDVRILEDGGIVIVDNGRGIPIEVHERESAKQGREVSALEVVLTVLHAGGKFDKDSYKVSGGLHGVGVSCVNALSEKLVATVFKDKKCYQMEFSRGIPVTPLQYVSVSDRQGTEIVFYPDPKIFSTCTFDRSILMKRLRELAFLNRGITIVFEDDRDVSFDKVTFFYEGGIQSFVSYLNQNKESLFSEPIYICGTRVGDDGEIEFEAALQWNSGYSELVYSYANNIPTRQGGTHLTGFSTALTRVINTYIKAHNLAKNNKLALTGEDIREGLTAVISVKVPNPQFEGQTKQKLGNSDVSSVAQQVVGEALTIFFEENPQIARMIVDKVFVAAQAREAAKKARELTLRKSALDSARLPGKLIDCLEKDPEKCEMYIVEGDSAGGSAKQGRDRRFQAILPIRGKILNVEKARLQKIFQNQEIGTIIAALGCGIGADNFNLSKLRYRRIIIMTDADVDGSHIRTLLLTFFYRHMTALIENECVYIAQPPLYKVSKKKDFRYILSEKEMDSYLLMLGTNESSILFKSTERELRGEALESFINVILDVESFINTLEKKAIPFSEFLEMYKEGIGYPLYYLAPATGMQGGRYLYSDEEKEEALAQEETHKFKIIELYKVAVFVDIQNQLKEYGLDISSYLIPQKNEIVIGNEDSPSCNYSCYTLEEVINYLKNLGRKGIEIQRYKGLGEMNADQLWDTTMNPEQRTLIHVSLKDAVEADHIFTMLMGEEVPPRREFIESHALSIRINNLDI

SEQ ID NO: 278 - protein, 116 aa, Chlamydia pneumoniae
  CPn0276
DMFLKRKKRGGSQVQNKRTASPIKHAKHYLHNYLQELQKIMAARPHDAIDAWNQVFRDKYKGMSQAIGFRDHILLVKVYNSSLYALLKQTPQNDLIMSLYQVASHVQIREIQFLLG

SEQ ID NO: 279 - protein, 200 aa, Chlamydia pneumoniae
  CPn0277
NISIFYPKYFIEGKEVLIKNLPPLIFYGVILMIINVRAPAFGITSVQQFSTNFQAAIPILNIVIGCSRISSTYAEDIEEVAQEKLEKSTHSKSSTSVNLWAHRVRGVVEILGGGIVILALEITALVLQVIIKLIKCLIDVLCVCLFGLGVCVVAIIGAIAFCVVVVVKYLGFCSQGEELEPIEVKTLISPDKPYPTVVYV

SEQ ID NO: 280 - protein, 275 aa, Chlamydia pneumoniae
  CPn0278
RDSMKKKLSLLVGLIFVLSSCHKEDAQNKIRIVASPTPHAELLESLQEEAKDLGIKLKILPVDDYRIPNRLLLDKQVDANYFQHQAFLDDECERYDCKGELVVIAKVHLEPQAIYSKKHSSLERLKSQKKLTIAIPVDRTNAQRALHLLEECGLIVCKGPANLNMTAKDVCGKENRSINILEVSAPLLVGSLPDVDAAVIPGNFAIAANLSPKKDSLCLEDLSVSKYTNLVVIRSEDVGSPKMIKLQKLFQSPSVQHFFDTKYHGNILTMTQDNG

SEQ ID NO: 281 - protein, 224 aa, Chlamydia pneumoniae
  CPn0279
KKIMQSDLIQILLKETVNTLYMVSTAFFFSCAIGGMLGLGLFCTSPKSLNPKKSLYATISMILSFLTAIPFAILIVILFPITRWIVGTSLGPTASIVPLTIGAIPFVVTIVVDAFRNSALNYLESAVALGIPKRNILFGILLPESYPQLIFSLKSLVVHLISCSTLAGFVGGGGLGQLLLQYGYYRFEWSVTTSVLVITLVLIESVRILGDFWGRRVLKYRGIL

SEQ ID NO: 282 - protein, 348 aa, Chlamydia pneumoniae
  CPn0280
IKGEAWLVSEQHSPIISVQDVSKKLGDHILLSKVSFSVYPGEVFGIVGHSGSGKTTLLRCLDFLDMPTSGSISVAGFDNSLPTQKFSRRNFSKKVAYISQNYGLFSSKTVFENIAYPLRIHHSEMSKSEVEEQVYDTLNFLNLYHRHDAYPGNLSGGQKQKVAIARAIVCQPEVVLCDEITSALDPKSTENIIERLLQLNQERGITLVLVSHEIDVVKKICSHVLVMHQGAVEELGTTEELFLNSENSITNELFHEDINIAALSSCYFAEDREEVLRLNFSKELAIQGIISKVIQTGLVSINILSGNINLFRKSPMGFLIIVLEGEVEQRKKAKELLIELGVVIKEFY

SEQ ID NO: 283 - protein, 357 aa, Chlamydia pneumoniae
  CPn0281
ISLRRHTLMLNIHDILGNDDENLLSYQCKHITKDKLTLPSHDFVDKVFGLSDRNNRVLRSLQTMFSHGRLANSGYLSILPVDQGIEHSAGASFAINPIYFDPENIVKLAIESGCSAVASTYGTLSLLSRKYAHKIPFMLKLNHNELLSYPTKYHQIFFTQVEAAYSMGAVAVGATVYFGSETSNEEIVAVSNAFAKARSLGLATVLWCYLRNPAFVANGVDYHTAADLTGQADHLGATLGADIVKQKLPTCQGGFKAINFGKTDERVYSELSSNHPIDLCRYQVLNSYCGKVGLINSGGPSGKNDFTEAARTAVINKRAGGMGLILGRKAFQRPLSEGIQLLNLVQDIYLDPNITIA

SEQ ID NO: 284 - protein, 482 aa, Chlamydia pneumoniae
  CPn0282
ILILQSLNFSKKVFMHSHSKPTKPLGTFTVGMLSLAVVISLRNLPLTAKHGLSTLFFYGLAVICFMIPYALISAELASFKPQGIYIWARDALGKWWGFFAIWMQWFHNMTWYPAVLAFIASTIVYKINPELAHNKVYIATVILAGFWILTFFNFLGITSSALFSSICVIIGTLIPGVILVSLALFWIFSGNPIAISLSWGNLLPNFSNVSSLVLLAGMLLALCGLEANANLASDMVNPRKNYPKAVFIGAIATLTILVLGSLSIAIVIPKEEISLVSGLVKTFTLFFDKYNLSWMTGIVVVMTIAGSLGELNAWMFAGTKGLFISTQNDCLPRLFKKVNSKNVPTNLMLFQGIVVTIFTLLFLCLDSADLVYWILTALSVQMYLAMYICLFLAGPILRIKEPRAQRLYSVPGKFLGICTMSILGILSCAFALWVSFLPPRELAQISEGSKIGYTTFLLLAFSLNCLIPFGIYFTHKRLSKKS

SEQ ID NO: 285 - protein, 350 aa, Chlamydia pneumoniae
  CPn0283
GRRLSYFQDLIKNAVAKIISFRKSPPNPVKLLIKFAKKDLKNSSIAPLYEVLLEILEAPGEEILEVLFSLDPMWLKSMLDPKKHSTLGIEISSETAETIESCSLGLISINLLLSGLCLRSSHDRSQAVKIIQQFCPQFSSEEVQNFVEQRNILTPFLHHLFEGDEVALLNQLSLRLDLIVPNALYPEPDPSCWQSINSEDCAKDAEDQQEDFNKTKEACKEGLKKLVLPALSITSIPQLLRARRFKQGAEILMAIDRKKMKQNPFIFLEALLESEEFSISVGKYLKLLMPIHLWDKLLHAIYLGYFQTGLICQGEIETFCRRANLNPEAFQAAIQQGRLLSFLFPKMLLD

SEQ ID NO: 286 - protein, 168 aa, Chlamydia pneumoniae
  CPn0284
FLDMNIPAPQVPVIDEPVVNNTSSYGLSLKSSLRPITYLILAILAIATLMSVLYFCGIISVGTFVLGMLIPLSVCSVLCVAYLFYQQSSIEKTKVFSITSPSVFFSDEDLNLLLGREEDSVSAIDELLKNFPADDFRRPKMLPYSNFLDEQGRPNESREEDSHTSKIL

SEQ ID NO: 287 - protein, 517 aa, Chlamydia pneumoniae
  CPn0285
KELFNLFFFTANKETTASHELIYRKNQSFSLSPVTILCLLAISVLLLLGVVFALVGCHVLAAPLGLLVWGCAASVCSMMAIVSLMCLYKGGKPLIEPSNEEKIDPTKDLEIKDPESLKPVPVEGQSLPKERKTVSFKAKIPSIVEDDFKPYVIQSTFYHQNKVYSKPIAERMQSLEKEITTLIVDFPRALEESSKSSGSLLRGVISEIKNLFLPRFLSRKVKYSLTACLRRLGSIVEEYASSDLLILLLTKPEPLNMVTQQLIAHLNSLKTEKRKLTPHMQKLVLSINFWFYGWSLEEKCIEKIVAYDPNLLTDELKAHLEAGNIVQFLLSFQSSEMQREFRALFPSDAQELPSAKDGSNYVPAINSSEYMYDFKDLSVLKKSLSERLAFCEKIPSPSSWNFTSSVASHYKDFSLLFTFFSNQQSVILQNPFLLIELLHENPKCQTFLKGLLEKAMPMSNWAALFRPMLMGMLCSGIARKKELKIIAEHLGVPFKEITQAIASGKILDLLLQHLFDF

SEQ ID NO: 288 - protein, 500 aa, Chlamydia pneumoniae
  CPn0286
SCRESKGKIMVGEQNRNEEKLDTAFSSGNLMDSRTSHLDDELSFKLEKAFTCLSTDIHSHDLSKIVIEYNPIDLAYAVSCLPSESRAILYKNLSCITAKVAFIINTDSASRWAIFRRLSDSEVCALIEQMPPDEAVWVLDDIPDRRYRRILELIDSKKALKIRDLQKHGRNTAGRLMTNEFFAFLMETTVKDVSACIRSNPGIDLTRLVFVLDFKGELQGVVTDRSLIINPPEMSLKQIMNQIEHKVLPDATREEVVDLVERYKIAALPVVDEENFLIGAITYEDVVEAIEDIADETIARMAGTTEDVGYQTCHVVQRFLLRAPWLLVTLFAGLISASVMAYFQKISPALLALIIFFIPLINGMSGNVGVQCSTILVRSMATGTLSFGRRRETIFKEMSIGLLTGVVLGILCGLVVYLMGFLGLNIFSGGGIQLGVTVATGVLGASLTATTLGVLSPFFFAKLGVDPALASGPIVTALNDIMSMIIFFLIAGGINFLFFN

SEQ ID NO: 289 - protein, 714 aa, Chlamydia pneumoniae
  CPn0287
RRCMIRSPLPFISSKRALNMLGLQDEFSCPEDVVDFLFSEIELLAQQDEPSEGYLALSRSLLMMTHNHPKVVKRVIFYGVSYGLKHKSMSIFIDVLTYIDFLFEKLGISASDRLSLCSARTCINFELYSQTGEMKFLSEVVDNFRLIEQLLKMHPQLKNRLGWEHFRIGAKQEEVSLVASASVYQAVGRSFIELYHKHLELSDLACGMKCLALALDLSPNNAHIHADYAKGLVVLGTRQGKSLLIERGMEHFSKAIFLSFSRDGDTLAYQNYRYSYALASVKLFDLTYKKEHFDQAMNILYQTVQAFPNLSGLWMVWGELLIRSGWLNSNMKYIEVGLEKLASLQKKTNDPIALSGLLATGIAILGLYLEEPNLFKDSRHRLISAMRTFPGNSALVHALGVVQLCSALYFNEDSHFASAISCFQSCLEWDLDATGMWQKLFDAYFSWGIKKKSARLLRKAVDVASRLCSLRPEAFLFWSDRGLALKCLAEATIDEAYKEIFLSESLLHYQRAWDLSGRLEILELWGQSHYLLAELQQSLFHYDEAYTLLTKVDLTLSSSRVKLILAAVLLGKGRLLQDTDPAEEAREILEPLVEVYLEDENFLLLLGKVYLFLFWKNKNVCLGKLARTYLEKATSLGCPEAYYTLGKFYAVIKDVNKAWGMVIRSAQYGVRITEAKWLNDPYLANLREIHAFREVVENQKGRLWLGNKTEMKRN

SEQ ID NO: 290 - protein, 405 aa, Chlamydia pneumoniae
  CPn0288
ISITIREFLFFGFECRAKFYNVIMSCFNLTSTNESLRPISPKASFPKQGWQSYFRSALRKHRSDTLSVSVCKVNKYDANLFVRLTVIALAVVGVLILFSIMLASIQGTLVITSWPLVTAAILIPTILLTGGMYILHRLGKKVDVISGVCIPPFSRRCWVPISSSHTLEKFDEKHVSACSYLDISTLSADGSGIAAVYQCPPLLFRAFPCFGIPCAMPFVALLRMIYNLIRFLVVPFYIIFRMIYEHFFCKHLPEDDRFIYKDVAREMGRSLAAFLKAPFYASACMIGAFYSLLDPLAGRVLMGSVERDWNDNVILARSVSLANEAHSLFRFEGGGGRKGLGQHAFYLMLCCQPQSVFLFDKGEIVSGAHPSIQLPERRGLDTSGRYPHISVIPDSGNDSAKNFIV

SEQ ID NO: 291 - protein, 400 aa, Chlamydia pneumoniae
  CPn0289
NFNRLMKKQRSHYKKNNLLLLLSILVGLGLGSVQSPWIVYSAECIANTFLKFLRLLSIPLVFCALGSTITSIQNFNTMVTLGKRILYYTLLTTVIAASIGLLLFFLLRPQMITQDALATTTKCNPLGYLDVLSDTLPENIFKPFLQGNVISAACLAVLLGTASLFLQEKEKHFVNQFFNSFFSIFLNLARGGLKLLPIAMLGFSVILFKELKDQSNLTMFAEYLLCVIGANLAQGFIVLPILLKINKVSPLKVAKAMSPALVTAFFSKSSAATLPLTMELAEDDLKINKNLSRFSFPLCSVINMNGCAAFILITVLFVATSNGMIISPLMSLGWIFIATLAAIGNAGVPMGCYFLTLSLLTSMNVPLSILGLILPFYTVIDMIETSLNVWSDCCVVSLAN

SEQ ID NO: 292 - protein, 499 aa, Chlamydia pneumoniae
  CPn0290
RSALTMNKKHASFSSRLGFIFSMIGIAVGAGNIWRFPRVAAQNGGGAFLILWLCFLFLWSIPLIIIELSIGKLTKKAPIGALIKTAGKKFAWAGGFITLVTTCILAYYSTIVGWGLSYFYYAVSGKIHLGNDFAKLWTSHYQSSIPLWAHLTSLGLAYLVIRKGIVHGIEKCNKILIPAFFLCTIALLLRAVTLPGAVQGIKQLFSCDKSCFSNYKVWIEALTQNAWDTGAGWGLLLVYAGFASKKTGVVSNGALTAICNNLVSLIMGIIIFSTCASLDILGTTQLQDGAGASSIGITFIYLPELFTRLPGGIYLTTLFSSIFFLAFSMAALSSMISMLFLLSQTLAEFGIKPYISETLATIIAFVLGIPSALSLTFFSNQDTVWGVALIVNGLIFIYAALVYGFPKLKKEVINAAPGDLRLNKAFDYIIKYLLPIEGILLLGWYFYEGLFPENGQWWNPISLYSLGSLVLQWSLGLIILWKFNKQLYLRFSRYNHEIL

SEQ ID NO: 293 - protein, 179 aa, Chlamydia pneumoniae
  CPn0291
EKHMSAPIPTPQELSDQITCLNVQYQQVSELARENKGDIEGLKTLTAALTADAGIQPSADEIYSLQTAAALILSASEKPGSGPSGSTEGSVTVQSPCKFKKVLAVVLTIIALIAIAVLIACIIAACGGFPLLLSALNLYTIGACVSLPIIASTSVALICLCTFVANSLIKPVITVRTTR

SEQ ID NO: 294 - protein, 212 aa, Chlamydia pneumoniae
  CPn0292
VKNTKNSDFMTSPIPFQSSGDASFLAEQPQQLPSTSESQLVTQLLTMMKHTQALSETVLQQQRDRLPTASIILQVGGAPTGGAGAPFQPGPADDHHHPIPPPVVPAQIETEITTIRSELQLMRSTLQQSTKGARTGVLVVTAILMTISLLAIIIIILAVLGFTGVLPQVALLMQGETNLIWAMVSGSIICFIALIGTLGLILTNKNTPLPAS

SEQ ID NO: 295 - protein, 928 aa, Chlamydia pneumoniae
  CPn0293
VWSMQRVLRLLFNLHHGEEKRAFLFFLLGLVWGIGCYGTLSLAEGLFIEKLGSAELPKIYLGSSLILCVLSSLILYNLFKKHISATALFLIPVSLSILCNFYLILSSIFAIDPPRSPLFFYRIVIWSLTILSYTSFWGFVDQFFNLQDGKRHFCIFNAIIFLGDAIGSGIIASLVHTIGIQGILILFTAALVLTFPIVFYVSKSLKSLSDDHDLFIDTGHPPPLSKALKLCFYDKYTFYLLCFYFLMQLLAIATEFNYLKIFEIQFASKEEFELVAHIGKCSLWISLGNMCFALFAYSRIVKRLGVNNIILFAPLCFLSLFLFWTFKTTLSIAVLAMVVREGVTYALDDNNLQLLIYGVPNKIRNQIRIVVESFIEPIGMLVWSLICFLSSQQYVFCLIISLIATILVCLVRSYYAKAILKNLSAQALQLTRSMQDWIKSMTVKQKRQVELFLLAHLKHPSERHQTFAFQHLLNLASRSVLPSLLAHMNKLSLPNKLKTIEMVKSSLWAKDFLTLELLKRWTSIFPHPAIASAIHLYFAEHDLLHITHIAEDLYDTVGDRLLAAILTVRRQEAYGPYRDLADKRLKELLNSDQPEDIVMGLTILKLEKNPQNFPILLDFLNTKNEDILIVTCKALHTSVRANHKPYCPELLKRLRQCSHNDEASQYLLKTISIALDISFVKDLLMTTSQLKNTSRKYAEAMIGELDKEVAPAFLQVLTDEGTHNRCRILAAKALCKIDNWLLKKHAYKIVKSKASKALFYSYHGHYIQKKYPTYNLSLLANTLNSNYYAEVNFMLSLLGILGSMEHSGVLIRALTSKNQKIKAQALESLEKNCDSHLFSLLEPFVNQPGMCYSEKYYFKCGVIPLTLKELLNMMENSPSSLNKLTAQQLKEELSYCDPDFQSVNTIYNQEHEDFRTEESETLISFLSI

SEQ ID NO: 296 - protein, 142 aa, Chlamydia pneumoniae
  CPn0294
IRNFFMNLIDRAFLLKKTIIFQSLDMDLLLTIADKTETIIFKPGSNVFSIGQPGFSFYIIVEGYITISKEKLESPLNLKPLDCFGEESLFNNKPREYNASANTQVRMLVLSKGQILNIVEECPSVALSFLELYAKQIKFREP

SEQ ID NO: 297 - protein, 80 aa, Chlamydia pneumoniae
  CPn0295
AMSLEDDVIAIIVEQLGVDPKEVNENSSFIEDLNADSLDLTELIMTLEEKFAFEISEEDAEKLRTVGDVFTYIKKRQAEQ

SEQ ID NO: 298 - protein, 257 aa, Chlamydia pneumoniae
  CPn0296
KIPIRGMICMDITLVGKKVIVTGGSRGIGLGIVKLFLENGADVEIWGLNEERGQAVIESLTGLGGEVSFARVDVSHNGGVKDCVQKFLDKHNKIDILVNNAGITRDNLLMRMSEDDWQSVISTNLTSLYYTCSSVIRHMIKARSGSIINVASIVAKIGSAGQTNYAAAKAGIIAFTKSLAKEVAARNIRVNCLAPGFIETDMTSVLNDNLKAEWLKSIPLGRAGTPEDVARVALFLASQLSSYMTAQTLVVDGGLTY

SEQ ID NO: 299 - protein, 317 aa, Chlamydia pneumoniae
  CPn0297
SRSNKDDNFMKKRYAFLFPGQGSQYVGMGQDLYMEYPEVRELFDFANERLGFSLTSIMFEGPEDLLMETVHSQLAIYLHSMAVVKVLSQRSSIQPSLVSGLSLGEYTALVASDRISVLDGLELVRKRGQLMNEACNQSPGAMAALLGLPSEVIEENITSLGQGIWIANYNAPKQLVVAGIAEKVDQAIELFRDLGCKKAVRLKVSGAFHTPLMQVAQDGLAPDIYALCMKDSSLPLVSHVVGKSLVNTEEMRECLARQMTSPTLWYQSCYHIESEVDEFLELGPGKVLAGLNRSIGISKPITSLGTFAQIEKFLSEV

SEQ ID NO: 300 - protein, 342 aa, Chlamydia pneumoniae
  CPn0298
YTSFFLYMWFSVNKNKKAAIWATGSYLPEKVLSNADLEKMVDTSDEWIVTRTGIKERRIAGPQEYTSLMGAIAAEKAIANAGLSKDQIDCIIFSTAAPDYIFPSSGALAQAHLGIEDVPTFDCQAACTGYLYGLSVAKAYVESGTYNHVLLIAADKLSSFVDYTDRNTCVLFGDGGAACVIGESRPGSLEINRLSLGADGKLGELLSLPAGGSRCPASKETLQSGKHFIAMEGKEVFKHAVRRMETAAKHSIALAGIQEEDIDWFVPHQANERIIDALAKRFEIDESRVFKSVHKYGNTAASSVGIALDELVHTESIKLDDYLLLVAFGGGLSWGAVVLKQV

SEQ ID NO: 301 - protein, 230 aa, Chlamydia pneumoniae
  CPn0299
RKKLVYYSESLYSNLNLGPRPECKNKIHITMTRYPDYLSKLIFFLRKLPGIGFKTAEKLAFELISWDSEQLKILGNAFHNVASERSHCPLCFTLKESKEADCHFCREERDNQSLCIVASPKDVFFLERSKVFKGRYHVLGSLLSPITGKHIENERLSILKSRIETLCPKEIILAIDATLEGDATALFLKQELQHFSVNISRLALGLPIGLSFDYVDSGTLARAFSGRHSY

SEQ ID NO: 302 - protein, 795 aa, Chlamydia pneumoniae
  CPn0300
GRLLGMLIMRNKVILQISILALIQTPLTLFSTEKVKEGHVVVDSITIITEGENASNKHPLPKLKTRSGALFSQLDFDEDLRILAKEYDSVEPKVEFSEGKTNIALHLIAKPSIRNIHISGNQVVPEHKILKTLQIYRNDLFEREKFLKGLDDLRTYYLKRGYFASSVDYSLEHNQEKGHIDVLIKINEGPCGKIKQLTFSGISRSEKSDIQEFIQTKQHSTTTSWFTGAGLYHPDIVEQDSLAITNYLHNNGYADAIVNSHYDLDDKGNILLYMDIDRGSRYTLGHVHIQGFEVLPKRLIEKQSQVGPNDLYCPDKIWDGAHKIKQTYAKYGYINTNVDVLFIPHATRPIYDVTYEVSEGSPYKVGLIKITGNTHTKSDVILHETSLFPGDTFNRLKLEDTEQRLRNTGYFQSVSVYTVRSQLDPMGNADQYRDIFVEVKETTTGNLGLFLGFSSLDNLFGGIELSESNFDLFGARNIFSKGFRCLRGGGEHLFLKANFGDKVTDYTLKWTKPHFLNTPWILGIELDKSINRALSKDYAVQTYGGNVSTTYILNEHLKYGLFYRGSQTSLHEKRKFLLGPNIDSNKGFVSAAGVNLNYDSVDSPRTPTTGIRGGVTFEVSGLGGTYHFTKLSLNSSIYRKLTRKGILKIKGEAQFIKPYSNTTAEGVPVSERFFLGGETTVRGYKSFIIGPKYSATEPQGGLSSLLISEEFQYPLIRQPNISAFVFLDSGFVGLQEYKISLKDLRSSAGFGLRFDVMNNVPVMLGFGWPFRPTETLNGEKIDVSQRFFFALGGMF

SEQ ID NO: 303 - protein, 200 aa, Chlamydia pneumoniae
  CPn0301
IKDLSKEIFVVFRKGFWYPFSIPKLVQVIMKKLLFSTFLLVLGSTSAAHANLGYVNLKRCLEESDLGKKETEELEAMKQQFVKNAEKIEEELTSIYNKLQDEDYMESLSDSASEELRKKFEDLSGEYNAYQSQYYQSINQSNVKRIQKLIQEVKIAAESVRSKEKLEAILNEEAVLAIAPGTDKTTEIIAILNESFKKQN

SEQ ID NO: 304 - protein, 367 aa, Chlamydia pneumoniae
  CPn0302
SKFKEFSMSEAPVYTLKQLAELLQVEVQGNIETPISGVEDISQAQPHHIAFLDNEKYSSFLKNTKAGAIILSRSQAMQHAHLKKNFLITNESPSLTFQKCIELFIEPVTSGFPGIHPTAVIHPTARIEKNVTIEPYVVISQHAHIGSDTYIGAGSVIGAHSVLGANCLIHPKVVIRERVLMGNRVVVQPGAVLGSCGFGYITNAFGHHKPLKHLGYVIVGDDVEIGANTTIDRGRFKNTVIHEGTKIDNQVQVAHHVEIGKHSIIVAQAGIAGSTKIGEHVIIGGQTGITGHISIADHVIMIAQTGVTKSITSPGIYGGAPARPYQETHRLIAKIRNLPKTEERLSKLEKQVRDLSTPSLAEIPSEI

SEQ ID NO: 305 - protein, 354 aa, Chlamydia pneumoniae
  CPn0303
REQKGLHHMDVSRKINRHTQFYVDSIDGVIKNFDHKPSEDKSRDHEELEEKLLTITKRIVASAQEFQNRKTDSKNYYLKKTQWLPFKNEELEQTKELFAMLTSMDKKIAQLFFYSPGCSSDWVEFTEVICHLNDSIGLGGVLLCCGLFEQQCEHVVTVNKKLDLPLLLGTTVVNSLRYYLTYRNISLLNCQSMSELGKELGDVLKQHGVAFTLIFKEIVDIDLLNYVKLIQGLKRSGNIQARIYDNDVPTLPSVSSSPIALRYSLANTIRGLALHVDFSSLKFISPSILSNTEHTAKALNSGGECFIFSNLDEFNLGMKIVMQLLRTGKISPEILNKNIMKILMIKRRVRSLYI

SEQ ID NO: 306 - protein, 356 aa, Chlamydia pneumoniae
  CPn0304
DQKPLPKRLPYKKVMDSSAPYNIASQGTEKSTVERILDLYGPASCIKFLKQMVLIREFEARGEEAYLEGLVGGFYHSYAGQEAVATAAIANTGLDPWVFSSYRCHALAILLNIPLQEIAAELLGKETGCALGRGGSMHMCGPNFPGGFGIVGGQIPLAAGAAFTIKYQEQKNRVSLCFIGDGAVAQGVFHETLNFVSLHQLPLMLIIENNGWSMGTSLNRAVAKQPIAESQGSSYDIRAVTVNGFDLFNSLLGFREAYRYMVDTESPVLVECLCSRFRGHSISDPNLYRSKEEMQCLFKKDPIVLAKDWLIRLEVLTEEEFQNIRQECKTAVLEAFSNAKLSSDPSVTTLEEGVYA

SEQ ID NO: 307 - protein, 332 aa, Chlamydia pneumoniae
  CPn0305
RKESMPKHKTLEIREALREAIDEEMSRDPNVCILGEEVGDYNGAYKVTKGLLDKWGPKRVIDAPISEAAFSGIGIGAALSGLRPIIEFMSWNFSFVALDQIISHAAKMHFMTGGKFSVPIVFRGPNGAAAQVSCQHSHCVESLYANIPGLIIIAPSNPYDAKGLLKSAIRNNNPVLFLENELEYNLKGEVPTEEYLVPIGKAHRVQEGNDLTIITYSRMVSITKEACSLAKKRWGLSIEIIDLRTIKPLDISTILSSVRKTSRCIVIEEGHYFAGISSEIIALITEHVFDSLDAPPLRVCQKETPMPYSKILEQATLPNVNRILDTIEKVMR

SEQ ID NO: 308 - protein, 432 aa, Chlamydia pneumoniae
  CPn0306
GKFVISLLKMPKLSPTMEVGTIVKWHKKSNDQVSFGDVIVEISTDKAILEHTANEDGWIREILRHEGEKIVIGTPIAVLSTEANEPFNLEELLPKTEPSNLEASPKGSSEEVSPATTPQAASATFTAVTFKPEPPLSSPLVFKHVGTTNNLSPLARQLAKEKNIDVSSIQGSGPGGRIVKKDLEKAPPKSIAGFGYPESPEVPPGSYHEENLSPIREVIAARLQAAKISIPHFYVRQQVYASPLLNLLKELQAQGIKLSINDCIVRACALALKEFPSINSGFNSVDNKIVRFDTIDISIAVAIPDGIITPIIRCADRKNLGMISAEIKSLALKARNQSLQDTEYKGGSFCVSNLGMTGITEFTAIVNPPQAAILAVGSVTEQALVLDGEITIGSTCNLTLSVDHRVIDGYPAAMFMKRLQKILEAPAVLLLN

SEQ ID NO: 309 - protein, 828 aa, Chlamydia pneumoniae
  CPn0307
NGCIVEDFSSFDKNKVSVDSMKRAILDRLYLSVVQSPESASPRDIFTAVAKTVMEWLAKGWLKTQNGYYKNDVKRVYYLSMEFLLGRSLKSNLLNLGILDLVRKALKTLNYDFDHLVEMESDAGLGNGGLGRLAACYLDSMATLAVPAYGYGIRYDYGIFDQRIVNGYQEEAPDEWLRYGNPWEICRGEYLYPVRFYGRVIHYTDSRGKQVADLVDTQEVLAMAYDIPIPGYGNDTVNSLRLWQAQSPRGFEFSYFNHGNYIQAIEDIALIENISRVLYPNDSITEGQELRLKQEYFLVSATIQDIIRRYTKTHICLDNLADKVVVQLNDTHPALGIAEMMHILVDREELPWDKAWEMTTVIFNYTNHTILPEALERWPLDLFSKLLPRHLEIIYEINSRWLEKVGSRYPKNDDKRRSLSIVEEGYQKRINMANLAVVGSAKVNGVSSFHSQLIKDTLFKEFYEFFPEKFINVTNGVTPRRWIALCNPRLSKLLNETIGDRYIIDLSHLSLIRSFAEDSGFRDHWKGVKLKNKQDLTSRIYNEVGEIVDPNSLFDCHIKRIHEYKRQLMNILRVIYVYNDLKENPNQDVVPTTVIFSGKAAPGYVMAKLIIKLINSVADVVNQDSRVNDKLKVLFLPNYRVSMAEHIIPGTDLSEQISTAGMEASGTGNMKFALNGALTIGTMDGANIEMAEHIGKENMFIFGLLEEQIVQLRREYCPQTICDKNPKIRQVLDLLEQGFFNSNDKDLFKPIVHRLLHEGDPFFVLADLESYIAAHENVNKLFKEPDSWTKISIYNTAGMGFFSSDRAIQDYARDIWHVPTKSCSGEGN

SEQ ID NO: 310 - protein, 128 aa, Chlamydia pneumoniae
  CPn0308
FFTQENNMATVAQTPQTTQPQPSVSHKATHRYCSWVFFKPILVSLGLLLASLTTLGLVIASGVTLSLGIGIVLAIQIVLAGIALVLAFNHIRQFKQARTAELNSMKMISAPAAATVQKQKLEDRYSSK

SEQ ID NO: 311 - protein, 461 aa, Chlamydia pneumoniae
  CPn0309
FMRAWEEFLLLQEKEIGTNTVDKWLRSLKVLCFDACNLYLEAQDSFQITWFEEHIRHKVKSGLVNNNNKPIRVHVTSVDKAAPFYKEKQMQQEKTAYFTMHYGSVNPEMTFSNFLVTPENDLPFRVLQEFTKSPDENGGVTFNPIYLFGPEGSGKTHLMQSAISVLRESGGKILYVSSDLFTEHLVSAIRSGEMQKFRSFYRNIDALFIEDIEVFSGKSATQEEFFHTFNSLHSEGKLIVVSSSYAPVDLVAVEDRLISRFEWGVAIPIHPLVQEGLRSFLMRQVERLSIRIQETALDFLIYALSSNVKTLLHALNLLAKRVMYKKLSHQLLYEDDVKTLLKDVLEAAGSVRLTPLKIIRNVAQYYGVSQESILGRSQSREYVLPRQVAMYFCRQKLSLSYVRIGDVFSRDHSTVISSIRLIEQKIEENSHDIHMAIQDISKNLNSLHKSLEFFPSEEMII

SEQ ID NO: 312 - protein, 808 aa, Chlamydia pneumoniae
  CPn0310
YFDLLSLIFRVYQMNKRTLLFVSLIGIAFVGCQIFFGYNEFRSCKNLAEKQRKISEQTLAAVESVGLSVASWDTDVNGEEHKNNYAVRVGDKLFLLHNGEAAQSVYSSGESWSFVDHKCGFDNIHLALYRQQGSSFNPTNTGKVFLPTNHEGLPVLVVEFRNNKEPLVFLGEYAQGRISNKDSTIFGTALVFWRSGSDYIPLGLYDSREEKLVSLDLPITRAVIFGNDQDSAKSSDTANHYVLFNDYMQIIVSEESGSIEGINLPFASTNNKSIVNEIGFDRDLASEKSPEALFPGLSSKLPDGQQAKNSIGGYYPLLRRGLLSDSKKLLPLEYHALNVVSGRELATPVALRYRVLSYTPHSIQLESLDRSVQKVYKLPENPEEKPYVFETAITLTKETEDVWVTSGVPEVEIMSNASAPTIKYRVIKKNKGSLDKVKLPKVKEPLAIRRGVYPQWILNSNGYFGIILTPLSEIASGYGSLYISGSTAPTRLSAISPKNQLYPVSKYPGYETLLPLPKDAGTHRFLVYAGPLAEPTLKVLDKTITQEKGENPEYLDSISFRGVFAFITAPFAALLFIIMKFFKLVTGSWGISIILLTVFLKLLLYPLNAWSIRSMRRMQILSPYIQQIQQKYKNEPKRAQMEIMGLYKTNKVNPITGCLPLLIQLPFLIAMFDLLKSSFLLRGASFIPGWIDNLTAPDVLFSWQTSIWFIGNEFHLLPILLGIVMFLQQKVTSLHKKGPVTDQQKQQQVMGNMMAILFTAMFYNFPSGLNIYWLSSMILGVVQQWITNKILDSKHLKNEVVLNNKKHR

SEQ ID NO: 313 - protein, 293 aa, Chlamydia pneumoniae
  CPn0311
DMRAEMAVIYWDRSKIVWSFEPWSLRLTWYGVFFTVGIFLACLSARYLALSYYGLKDHLSFSKSQLRVALENFFIYSILFIVPGARLAYVIFYGWSFYLQHPEEIIQIWHGGLSSHGGVLGFLLWAAIFSWIYKKKISKLTFLFLTDLCGSVFGIAAFFIRLGNFWNQEIVGTPTSLPWGVVFSDPMQGVQGVPVHPVQLYEGISYLVVSGILYFLSYKRYLHLGKGYVTSIACISVAFIRFFAEYVKSHQGKVLAEDCLLTIGQILSIPLFLFGVALLIICSLKARRHRSHI

SEQ ID NO: 314 - protein, 153 aa, Chlamydia pneumoniae
  CPn0312
CTMARNIKYFLILFPGILWISAGMKLLLKATAIALDPLSSFFTYCLLSMVSWGLASLKHRYLLSKTIRKQLSLSSEFFSQKITWIAYIKQTFISRRFLIMVIMIAFSLVLRRYISNPQALFVIRATVGYALIKTAIAYFSKLQNALMENPEGN

SEQ ID NO: 315 - protein, 133 aa, Chlamydia pneumoniae
  CPn0313
WKILKEISANSMEIIHIGTDIIEISRIREAIATHGNRLLNRIFTEAEQKYCLEKTDPIPSFAGRFAGKEAVAKALGTGIGSVVAWKDIEVFKVSHGPEVLLPSHVYAKIGISKVILSISHCKEYATATAIALA

SEQ ID NO: 316 - protein, 311 aa, Chlamydia pneumoniae
  CPn0314
MIHSRLIIIGSGPSGYTAAIYASRALLHPLLFEGFFSGISGGQLMTTTEVENFPGFPEGILGPKLMNNMKEQAVRFGTKTLAQDIISVDFSVRPFILKSKEETYSCDACIIATGASAKRLEIPGAGNDEFWQKGVTACAVCDGASPIFKNKDLYVIGGGDSALEEALYLTRYGSHVYVVHRRDKLRASKAMEARAQNNEKITFLWNSEIVKISGDSIVRSVDIKNVQTQEITTREAAGVFFAIGHKPNTDFLGGQLTLDESGYIVTEKGTSKTSVPGVFAAGDVQDKYYRQAVTSAGSGCIAALDAERFLG

SEQ ID NO: 317 - protein, 580 aa, Chlamydia pneumoniae
  CPn0315
MPKQAEYTWGSKKILDNIECLTEDVAEFKDLLYTAHRITSSEEESDNEIQPGAILKGTVVDINKDFVVVDVGLKSEGVIPMSEFIDSSEGLVLGAEVEVYLDQAEDEEGKVVLSREKATRQRQWEYILAHCEEGSIVKGQITRKVKGGLIVDIGMEAFLPGSQIDNKKIKNLDDYVGKVCEFKILKINVERRNIVVSRRELLEAERISKKAELIEQISIGEYRKGVVKNITDFGVFLDLDGIDGLLHITDMTWKRIRHPSEMVELNQELEVIILSVDKEKGRVALGLKQKEHNPWEDIEKKYPPGKRVLGKIVKLLPYGAFIEIEEGIEGLIHISEMSWVKNIVDPSEVVNKGDEVEAIVLSIQKDEGKISLGLKQTERNPWDNIEEKYPIGLHVNAEIKNLTNYGAFVELEPGIEGLIHISDMSWIKKVSHPSELFKKGNSVEAVILSVDKESKKITLGVKQLSSNPWNEIEAMFPAGTVISGVVTKITAFGAFVELQNGIEGLIHVSELSDKPFAKIEDIISIGENVSAKVIKLDPDHKKVSLSVKEYLADNAYDQDSRTELDFKDSQGPKERKKKGK

SEQ ID NO: 318 - protein, 446 aa, Chlamydia pneumoniae
  CPn0316
LFTDFLIYKPSIMNKNLVAIFDYMEKEKGIQRSTIIGAIESALKIAAKKTLRDDANISVNINSRTGDIEVFCEKEIVEICQNPSKEIPLDKAREYDPDCQIGQYMDVPFVSDNFGRIAAHAARQIIGQKLRHAERDVIYEEYRHRVNETLSGVVKRFAKGSNLIIDLGKVEAILPTRFYPKTEKHKIGDKIYALLYEVQESENGGAEVILSRSHAEFVKQLFIQEVPELEEGSVEIVKIAREAGYRTKLAVRSSDPKTDPVGAFVGMRGSRVKNIIRELNDEKIDIVNYSPVSTELLQNLLYPIEIQKIAILEDDKVIAIVVNDADYATVIGKRGINARLISHILDYELEVQRMSEYNKLLEIQRLQLAEFDSPHLDQPLEMEGISKLVIQNLEHAGYDTIRRVLLASANDLASVPGISLELAYKILEQVSKYGESKVDEKPEIED

SEQ ID NO: 319 - protein, 902 aa, Chlamydia pneumoniae
  CPn0317
SLLIRSLSKSANMEKVKLTKNLKLKIKNAQLTKAAGLDKLKQKLAQAGSSEAKSSSEKPSAKEKSVKVALAATSTPTASAEQASPESTSRRIRAKNRSSFSSSEEESSAHIPVDTSEPAPVSIADPEPELEVVDEVCDESPEVHPVAEVLPEQPVLPETPPQEKELEPKPVKPAEPKSVVMIKSKFGPTGKHINHLLAKTFKAPAKEEKVVAGSKSTKPVASDKTGKPGTSEGGEQNNREKQFNPANRSPASGPKRDAGKKNLTDFRDRSKKSDESLKAFTGRDRYGLNEGGEEDRWRKKRVYKPKKHYDEASIQRPTHIKISLPITVKDLAAEMKLKASEVIQKLFIHGMTYVVNDILDSETAVQFIGLEFGCTIDIDYSEQDKLCLSNDTVRDEIQSTDPSKLVIRSPIVAFMGHVDHGKTTLIDSLRKSNVAATEAGAITQHMGAFCCSTPVGDITILDTPGHEAFSAMRARGAEVCDIVVLVVAGDEGIKEQTLEAIEHAKAADIAIVVAINKCDKPNFNSETIYRQLSEINLLPEAWGGSTVTVNTSAKTGEGLSELLEMLALQAEVLELKADPSARARGLVIESELHKGLGPVATVLIQNGSLKLGEALVFNDCYGKVKTMHNEHNELMKEAGPSIPVLITGLSDIPKAGDPFFVVKNEKTARDIIEARSAGQQRFALQQKKRPNFDSMLQNKKTLKLMIKADVQGSIEALVSSISKIKSEKVDVEILTNSVGEISESDIRLAAASKAVLIGFHTGIESHAEPLIKSLGVRVELFTVIYHAIDAIKEIMTSLLDPIAEEKDEGSAEIKEIFRSSQVGSIYGCIVTEGIMTRNHKVRVLRNKEILWKGTLSSLKRVKEDVKEVRKGLECGILLEGYQQAQIGDVLQCYEVIYHPQKL

SEQ ID NO: 320 - protein, 141 aa, Chlamydia pneumoniae
  CPn0318
VMSYNVMKLSIIHKNYNLKYCMTENRRIKRVNALLQEAIAKVILKDVKHPKISNLWITVTRVSLSKDLHSARVYVSVMPHENTKEEALEALKVSAGFIAHRASKNVVLKYFPELHFYLDDIFSPQDYIENLLWQIQEKEKS

SEQ ID NO: 321 - protein, 249 aa, Chlamydia pneumoniae
  CPn0319
TIFFGNLNTIKDMTMDLAVELKEGILLVDKPQGRTSFSLIRALTKLIGVKKIGHAGTLDPFATGVMVMLIGRKFTRLSDILLFEDKEYEAIAHLGTTTDSYDCDGKVVGRSKKIPSLEEVLSAAEYFQGEIQQLPPMFSAKKVQGKKLYEYARKGLSIERHHSTVQVHLQITKYEYPLLHFVVSCSKGTYIRSIAHELGTMLGCGAYLEQLRRLRSGRFSIDECIDGNLLDHPDFDISPYLRDAHGNSL

SEQ ID NO: 322 - protein, 320 aa, Chlamydia pneumoniae
  CPn0320
TTPISIFLPTYEMPMEIAYSLTSSFSVDSVTVGFFDGCHLGHSNLLSILTSYSGSSGVITFDSHPQTVLSLNHTKLINTKEERLQLLQTFPIDWLGVLTFDLNFANQSAEEFLTLLHRNLKCKRLILGYDSCIGKEQQSNTEALDTIGKPLGIEVIKIPPYRMDNIVVSSKAIRQFLSAGNLECAHRFLGHPYAISGKITEGSGIGGSLGFATINLPREESLIPLGVYACEIRYDSTTCQGVMNLGTAPTFGRESLYAEAHIFSFAENLYGKEVSIIPRKFLREEKKFQSKETLIRAIEKDILDAQDWFAKGSFNYEGTA

SEQ ID NO: 323 - protein, 378 aa, Chlamydia pneumoniae
  CPn0321
YSKKHVIIFIFRCLMSHTECGIVGLPNVGKSGLFNALTGAQVASCNYPFCTIDPNVGIVPVIDERLEALAKISNSQKIIYADMKFVDIAGLVKGASDGAGLGNRFLSHIRETHAIAHVVRCFDDPDVTHVSGKVNPVEDIEVINLELIFSDFSSAKNIHSKLEKLAKGKREVGALLPLFDTIIAHLEKGLPLRTLELTPEQIVALKPYPFLTMKPMFYIANVDESSLPDMDNDYVAAVREVAAKENSKVVPICVRIEEEIVSLPIEERLEFLMSLGLEKSGLHRLVRAAYDTLGLISYFTTGPQESRAWTVVRGSSAWEAAGEIHTDIQKGFIRAEVITFEDMIECQGRAAARELGKLHIEGRDYIVQDGDTMLFLHN

SEQ ID NO: 324 - protein, 366 aa, Chlamydia pneumoniae
  CPn0322
SNLGNSMGEKTEKATPKRLRDARKKGQVAKSQDFPSAVTFIVSMFTAFSLSTFFFKHLGGFLVSMLSQAPTRHDPVITLFYLKNCLMLILTASLPLLGAVAVVGVIVGFLIVGPTFSTEVFKPDIKKFNPIENIKQKFKIKTLIELIKSILKIFGAALILYITLKSKVSLIIETAGVSPIITAQIFKEIFYKAVTSIGIFFLIVAILDLVYQRHNFAKELKMEKFEVKQEFKDTEGNPEIKGRRRQIAQEIAYEDSSSQVKHASTVVSNPKDIAVAIGYMPEKYKAPWIIAMGINLRAKRILDEAEKYGIPIMRNVPLAHQLLDEGKELKFIPESTYEAIGEILLYITSLNAQNPNNKNTNQPDHL

SEQ ID NO: 325 - protein, 713 aa, Chlamydia pneumoniae
  CPn0323
SFIMNKLLNFVSRTLGGDTALNMINKSSDLILALWMMGVVLMIIIPLPPPIVDLMITINLSISVFLLMVALYIPSALQLSVFPSLLLITTMFRLGINISSSRQILLKAYAGHVIQAFGDFVVGGNYVVGFIIFLIITIIQFIVVTKGAERVAEVAARFRLDAMPGKQMAIDADLRAGMIDATQARDKRAQIQKESELYGAMDGAMKFIKGDVIAGIVISLINIVGGLTIGVAMHGMDLAQAAHVYTLLSIGDGLVSQIPSLLIALTAGIVTTRVSSDKNTNLGKEISTQLVKEPRALLLAGAATLGVGFFKGFPLWSFSILALIFVALGILLLTKKSAAGKKGGGSGASTTVGAAGDGAATVGDNPDDYSLTLPVILELGKDLSKLIQHKTKSGQSFVDDMIPKMRQALYQDIGIRYPGIHVRTDSPSLEGYDYMILLNEVPYVRGKIPPHHVLTNEVEDNLSRYNLPFITYKNAAGLPSAWVSEDAKAILEKAAIKYWTPLEVIILHLSYFFHKSSQEFLGIQEVRSMIEFMERSFPDLVKEVTRLIPLQKLTEIFKRLVQEQISIKDLRTILESLSEWAQTEKDTVLLTEYVRSSLKLYISFKFSQGQSAISVYLLDPEIEEMIRGAIKQTSAGSYLALDPDSVNLILKSMRNTITPTPAGGQPPVLLTAIDVRRYVRKLIETEFPDIAVISYQEILPEIRIQPLGRIQIF

SEQ ID NO: 326 - protein, 407 aa, Chlamydia pneumoniae
  CPn0324
YVVAHRRHMAASGGTGGLGGTQGVNLAAVEAAAAKADAAEVVASQEGSEMNMIQQSQDLTNPAAATRTKKKEEKFQTLESRKKGEAGKAEKKSESTEEKPDTDLADKYASGNSEISGQELRGLRDAIGDDASPEDILALVQEKIKDPALQSTALDYLVQTTPPSQGKLKEALIQARNTHTEQFGRTAIGAKNILFASQEYADQLNVSPSGLRSLYLEVTGDTHTCDQLLSMLQDRYTYQDMAIVSSFLMKGMATELKRQGPYVPSAQLQVLMTETRNLQAVLTSYDYFESRVPILLDSLKAEGIQTPSDLNFVKVAESYHKIINDKFPTASKVEREVRNLIGDDVDSVTGVLNLFFSALRQTSSRLFSSADKRQQLGAMIANALDAVNINNEDYPKASDFPKPYPWS

SEQ ID NO: 327 - protein, 151 aa, Chlamydia pneumoniae
  CPn0325
KRIAMQNQYEQLLESLAPLLNTTLAPDKNNSCLIRFSDTHVPVQIEEDGNSGDLAVSTLLGTLPENVFRERIFKAALSVNGSFQSSIKGILGYGEVTQQLYLSDILSMNYLNGEKLFEYLKLFSLHAKIWMESLRTGNLPDLHVLGIYYVA

SEQ ID NO: 328 - protein, 536 aa, Chlamydia pneumoniae
  CPn0326
PSCFGNLLRRVNVLKYTKHSPSAHAWKLIGTSPKHGIYLPLFSIHTKNSCGIGEFLDLIPLISWCQKQGFSVIQLLPLNDTGEDTSPYNSISSVALNPLFLSLSSLPNIDTIPEVAKKLQDMHELCSTPSVSYTQVKEKKWAFLREYYQKCCKSSLEGNSNFSEFLESERYWLYPYGTFRAIKHHMHGEPINNWPKSLTDQENFPDLTKKFHDEVLFFSYLQFLCYQQLCEVKAYADQHHVLLKGDLPILISKDSCDVWYFRDYFSSSRSVGAPPDLYNSEGQNWHLPIYNFSQLAKDDYIWWKERLRYAQNFYSVYRLDHIIGFFRLWIWDSSGRGRFIPDNPKDYIKQGTEILSTMLGASSMLPIGEDLGIIPQDVKTTLTHLGICGTRIPRWERNWESDSAFIPLKDYNPLSVTTLSTHDSDTFAQWWLNSPKEAKQFAKFLHLPFQKTLTTETQIDILKLSHESASIFHINLFNDYLALCPDLVSKNLQRERINTPGTISKKNWSYRVRPSLEELAIHKKFNGYIEKILTGL

SEQ ID NO: 329 - protein, 95 aa, Chlamydia pneumoniae
  CPn0327
RIHRKNMSRKCPLTGKRPRRGYSYTLRGIAKKKKGIGLKVTGKTKRRFFPNMLTKRLWSTEENRFLKLKISASALRHIDKLGLEKVLERAKSKNF

SEQ ID NO: 330 - protein, 591 aa, Chlamydia pneumoniae
  CPn0328
LKYREIFMSFLRRHISLFRSQKQLIDVFAPVSPNLELAEIHRRVIEDQGPALLFHNVIGSSFPVLTNLFGTKHRVDQLFSQAPDNLIARVAHLISSTPKLSSLWKSRDLLKRISSLGLKKARFRRFPFVSMSSVNLDHLPLLTSWPEDGGAFLTLPLVYTESPTLTTPNLGMYRVQRFNQNTMGLHFQIQKGGGMHLYEAEQKKQNLPVSVFLSGNPFLTLSAIAPLPENVSELLFATFLQGAKLLYKKTNDHPHPLLYDAEFILVGESPAGKRRPEGPFGDHFGYYSLQHDFPEFHCHKIYHRKDAIYPATVVGKPYQEDFYIGNKLQEYLSPLFPLVMPGVRRLKSYGESGFHALTAAVVKERYWRESLTTALRILGEGQLSLTKFLMVTDQEVPLDRFSVVLETILERLQPDRDLIIFSETANDTLDYTGPSLNKGSKGIFMGIGKAIRDLPHGYQGGKIHGVQDIAPFCRGCLVLETSLEDRCIKSLLHHPDLKSWPLIILADNLRETIQSEKDFLWRTFTRCAPANDLHALHSHFATHRPNYNFPFVIDALMKPSYPKEVEVDPSTKQKVSERWHAYFPNKETFYI

SEQ ID NO: 331 - protein, 354 aa, Chlamydia pneumoniae
  CPn0329
KMNKRQKDKLKICVIISTLILVGIFARAPRGDTFKTFLKSEEAIIYSNQCNEDMRKILCDAIEHADEEIFLRIYNLSEPKIQQSLTRQAQAKNKVTIYYQKFKIPQILKQASNVTLVEQPPAGRKLMHQKALSIDKKDAWLGSANYTNLSLRLDNNLILGMHSSELCDLIITNTSGDFSIKDQTGKYFVLPQDRKIAIQAVLEKIQTAQKTIQVAMFALTHSEIIQALHQAKQRGIHVDIIIDRSHSKLTFKQLRQLNINKDFVSINTAPCTLHHKFAVIDNKTLLAGSINWSKGRFSLNDESLIILENLTKQQNQKLRMIWKDLAKHSEHPTVDDEEKEIIEKSLPVEEQEAA

SEQ ID NO: 332 - protein, 243 aa, Chlamydia pneumoniae
  CPn0330
FISIEMLLLSRQLFSVLPSRFQDLHVYRFKESLKLLQFMTMVGGEIVVVLAEIKEEDLRARKLPVRKRREKNYLRIFRVLSRFDVMRIIRFDPYGALSAQSIAKDSRQNSPLVEKISEEIATNEAIRLALLAIGDREQEEKKQRHRYKLLGQKQAKVLLSQLRHVHLDFKKLYCDSKKKEDQEKDEKNKQKRSIKVTKKKKGISLGAAASQAIAAAAEAWVIARNKGVLETASTLFYQKDEEA

SEQ ID NO: 333 - protein, 584 aa, Chlamydia pneumoniae
  CPn0331
IQRIIMAVSGGGGVQPSSDPGKWNPALQGEQAEGPSPLKESIFSETKQASSAAKQESLVRSGSTGMYATESQINKAKYRKAQDRSSTSPKSKLKGTFSKMRASVQGFMSGFGSRASRVSAKRASDSGEGTSLLPTEMDVALKKGNRISPEMQGFFLDASGMGGSSSDISQLSLEALKSSAFSGARSLSLSSSESSSVASFGSFQKAIEPMSEEKVNAWTVARLGGEMVSSLLDPNVETSSLVRRAMATGNEGMIDLSDLGQEEVSTAMTSPRAVEGKVKVSSSDSPEANPTGIPNSNTLERAEKEAEKQESREQLSEDQMMLARAMAGLLTGAAPQEVLSNSVWSGPSTVFPPPKFSGTLPTQRSGDKSKHKSPGIEKSTNHTNFSPLREGTVKSAEVKSLPHPESMYRFPKDSIVSREEPEAVVKESTAFKNPENSSQNFLPIAVESVFPKESGTGGALGSDAVSSSYHFLAQRGVSLLAPLPRATDDYKEKLEAHKGPGGPPDPLIYQYRNVAVEPPIVLRSPQPFSGSSRLSVQGKPEAASVHDDGGGGNSGGFSGDQRRGSSGQKASRQEKKGKKLSTDI

SEQ ID NO: 334 - protein, 47 aa, Chlamydia pneumoniae
  CPn0332
YLDSRIRVIPLARQRCTLLHLLAVLCPPISFFTQGVSPCVFFCFLDF

SEQ ID NO: 335 - protein, 106 aa, Chlamydia pneumoniae
  CPn0333
VDFFVFVFFMGKPKKSRTDRALAQEIQKKSTEVLKKPARIKAKNRRKFLIAKEQKTLKHRAQEYDQLVRSLLDSQKKDTDKVLIFNYENGFVFTDKDHFSKYSIRL

SEQ ID NO: 336 - protein, 172 aa, Chlamydia pneumoniae
  CPn0334
TMSVHITPRKCFILCILSMFTLPTLFPKAHLILFSPYIVLCFYCFSKDKGLVLALGCGVLSDLALGSRGVFLLLYPLTALITHKAHLIFSKESKAALVIVNMIFYGVFLLLTIPMCALFGHEVRWSIDVLMIPLKCSFLDNLIFTSVIYILPCAINSGIHKMISFFRRLVCY

SEQ ID NO: 337 - protein, 289 aa, Chlamydia pneumoniae
  CPn0335
EIGMLLRGIPAAEKILQRLKEEISQSPTSPGLAVVLIGNDPASEVYVGMKVKKATEIGIISKAHKLPSDSTLSSVLKLIERLNQDPSIHGILVQLPLPKHLDSEVILQAISPDKDVDGLHPVNMGKLLLGNFDGLLPCTPAGIIELLNYYEIPLRGRHAAIVGRSNIVGKPLAALMMQKHPQTNCTVTVLHSQSENLPEILKTADIIIAALGAPLFIKETMVAPHAVIVDVGTTRVPADNAKGYTLLGDVDFNNVVTKCAAITPVPGGVGPMTVAMLMSNTWRCYQNFS

SEQ ID NO: 338 - protein, 341 aa, Chlamydia pneumoniae
  CPn0336
RCDKMRSNHSSSWRRWSHDCRYAHEQYMAMLPKFFLVLLCLGLCSCSQKTTTIEGEQMTIFYRIVLGTSLSAKEKASLSQQIDRCFHKIDSIYNNWNPYSELSIINRAPADVPITLSVELSEFLDQVDTLYKLSEGRFDPTVGPLKTLWLLHLKSQTLPPKDVWEQHYKDMGWQHLEFQSNTKTLIKKNPHVQIDLCGVVKGYAVDCLNEICNTFCPNNYVEWGGEIKTSGHHPSGRPWRIFSEAAGTILDIDDMAIATSGNHIQKWCVEGKIYTHILDTRTGKPLELSSYPIQSVSVVHPSCAYADAIATVLMTFDSKIEAKQWAEEHHILTYINDGASS

SEQ ID NO: 339 - protein, 189 aa, Chlamydia pneumoniae
  CPn0337
IEEIFPGNQGKRILIIVLRRKNCFLLYWFLSPIMGEDLMAQKEIVSNRKALRNYEVIETLEAGIVLTGTEIKSLRDHGGNLGDAYVIVSKGEGWLLNASIAPYRFGNIYNHEERRKRKLLLHRYELRKLEGKIAQKGMTLIPLGMFLSRGYVKVRLGCCRGKKAYDKRRTIIEREKEREVAAAMKRRHH

SEQ ID NO: 340 - protein, 368 aa, Chlamydia pneumoniae
  CPn0338
ENMKFVVSRNELGNLIKKIQSVVPQNTPIPVLTHVLIETYNDELVFTATDLTVSTRCVTKAKVYEKGAISIPSKRFFQLVKELTEANLEISSSAGEMAQITSGSSCFRLLSMEKEDFPMLPDIQNALRFSLPAEQLKTMLQRTSFAVSREESRYVLTGVLLAIANGVATIVGTDGKRLAKIDAEVTLDKSFSGEYIIPIKAVEEIIKMCSDEGEAAIFLDQDKIAVECDNTLLITKLLSGEFPDFSPVISTESNVKLDLHREELITLLKQVALFTNESSHSVKFSFLPGELTLTANCTKVGEGKVSMAVNYSGELLEIAFNPFFFLDILKHSKDELVSLGISDSYNPGIITDSASGLFVIMPMRLHDD

SEQ ID NO: 341 - protein, 210 aa, Chlamydia pneumoniae
  CPn0339
VTTLPMFMKICSLKLKNFRNHSDLEISLAPKLNYAQGKTNLLEALYVLSLGRSFRTQHLTDTITFGSSHFFLETQFEKDHLPQALSIYTDKQGKKICYNQLPIKTLSQLIGKVPIVLFSSKDRLLISGAPADRRLFLNLLLSQCDNHYTLCLSYYHRALQQRNALLKSKQTSTVASGMNSWSNTAPTYPSNGFSVVRNFQIYPKNFGLTT

SEQ ID NO: 342 - protein, 105 aa, Chlamydia pneumoniae
  CPn0340
PLYPLLIVLSSRSSAEKCSLKKQANLNRGLWDEQLVKHGTYLSIQRFLCSQKLSDLSKELWSNNLKEQLALKFKSSLIKNSDISETAVAEEFHKQLSISLPRDLE

SEQ ID NO: 343 - protein, 112 aa, Chlamydia pneumoniae
  CPn0341
GSTSVGPHREDFLLTMNQMPVSQFSSEGQKHSLLAILRLAECLYLKQSHHVSPLVCLDDIHAGLDNERVGQLLDPAPTLGQTLITSTHMHGELPKTSLVLSIENAQVSEQII

SEQ ID NO: 344 - protein, 148 aa, Chlamydia pneumoniae
  CPn0342
HMKKFLLTILFLAVGNPLFSETSVIQTLPSGIGGLKETSKQKESVVCVHAFLRSYTSLKPIARVLEKEHYDVFIWNYETRKFTLEKHAEHLNRLLKKIAELKPGVPINFVTHSIGGVIVRVALAHPDCPEEAKKEKLFSWLLRTQGLH

SEQ ID NO: 345 - protein, 199 aa, Chlamydia pneumoniae
  CPn0343
LPRRSQKRKAILMAPPNAGSTLARRYRCVKFVQFVFGGKLGRQLLTYCPTKMLNVGKLPSSLDVLILSGNRHSKFLPFRLPYENDGKVCTIETKLDTPHKAYVIHTSHTYIITNRKSLYLMKEFLKEGNTTPIIEHVPEAALEQTVMEDKQKNSRLKPYPNQDIYVIHCFGSRPYNLYGFPKKWSLNQKNEINPEKLEK

SEQ ID NO: 346 - protein, 625 aa, Chlamydia pneumoniae
  CPn0344
SSRYMTIIYFILAALALGILVLIHELGHLVVAKAVGMAVESFSIGFGPALFKKRIGGIEYRIGCIPFGGYVRIRGMERTKEKGEKGKIDSVYDIPQGFFSKSPWKRILVLVAGPLANILLAVLAFSILYMNGGRSKNYSDCSKVVGWVHPVLQAEGLLPGDEILTCNGKPYVGDKDMLTTSLLEGHLNLEIKRPGYLTVPSKEFAIDVEFDPTKFGVPCSGASYLLYSNQVPLTKNSPMENSELRPNDRFVWMDGTLLFSMAQISQILNESYAFVKVARNDKIFFSRQPRVLASVLHYTPYLRNELIDTQYEAGLKGKWSSLYTLPYVINSYGYIEGELTAIDPESPLPQPQERLQLGDRILAIDGTPVSGSVDILRLVQNHRVSIIVQQMSPQELEEVNSRDADKRFIASYHSEDLLQILNHLGESHPVEVAGPYRLLDPVQPRPWIDVYSSESLDKQLEVAKKIKNKDKQRYYLERLDAEKQKPSLGISLKDLKVRYNPSPVVMLSNITKESLITLKALVTGHLSPQWLSGPVGIVQVLHTGWSVGFSEVLFWIGLISMNLAVLNLLPIPVLDGGYILLCLWEIVKRRRLNMKIVERILVPFTFLLIIFFIFLTFQDLFRFFG

SEQ ID NO: 347 - protein, 384 aa, Chlamydia pneumoniae
  CPn0345
LKVACLKHLAVLGSTGSIGRQTLEIVRRYPSEFKIISMASYGNNLRLFFQQLEEFAPLAAAVYNEEVYNEACQRFPHMQFFLGQEGLTQLCIMDTVTTVVAASSGIEALPAILESMKKGKALALANKEILVCAGELVSKTAKENGIKVLPIDSEHNALYQCLEGRTIEGIKKLILTASGGPLLNKSLEELSCVTKQDVLNHPIWNMGSKVTVDSSTLVNKGLEIIEAYWLFGLENVEILAVIHPQSLIHGMVEFLDGSVISIMNPPDMLFPIQYALTAPERFASPRDGMDFSKKQTLEFFPVDEERFPSIRLAQQVLEKQGSSGSFFNAANEVLVRRFLCEEISWCDILRKLTTLMECHKVYACHSLEDILEVDGEARALAQEI

SEQ ID NO: 348 - protein, 329 aa, Chlamydia pneumoniae
  CPn0346
KKGSLMALGPSPYYGVSFFQFFSVFFSRLFSGSLFTGSLYIDDIQIIVFLAISCSGAFAGTFLVLRKMAMYANAVSHTVLFGLVCVCLFTHQLTTLSLGTLTLAAMATAMLTGFLIYFIRNTFKVSEESSTALVFSLLFSLSLVLLVFMTKNAHIGTELVLGNADSLTKEDIFPVTIVILANAVITIFAFRSLVCSSFDSVFASSLGIPIRLVDYLIIFQLSACLVGAFKAVGVLMALAFLIIPSLIAKVIAKSIRSLMAWSLVFSIGTAFLAPASSRAILSAYDLGLSTSGISVVFLTMMYIVVKFISYFRGYFSKNFEKISEKSSQY

SEQ ID NO: 349 - protein, 467 aa, Chlamydia pneumoniae
  CPn0347
TFGTNPEALSRKTIWIVLIMLSCVFSDTIFLSSFLAVTLICMTTALWGTILLISKQPLLSESLSHASYPGLLVGALMAQYVFSLQASIFWIVLFGCAASVFGYGIIVFLGKVCKLHKDSALCFVLVVFFAIGVILASYVKESSPTLYNRINAYLYGQAATLGFLEATLAAIVFCASLFALWWWYRQIVVTTFDKDFAVTCGLKTVLYEALSLIFISLVIVSGVRSVGIVLISAMFVAPSLGARQLSDRLSTILILSAFFGGISGALGSYISVAFTCRAIIGQQAVPVTLPTGPLVVICAGLLAGLCLLFSPKSGWVIRFVRRKHFSFSKDQEHLLKVFWHISHNRLENISVRDFVCSYKYQEYFGPKPFPRWRVQILEWRGYVKKEQDYYRLTKKGRSEALRLVRAHRLWESYLVNSLDFSKESVHELAEEIEHVLTEELDHTLTEILNDPCYDPHRQIIPNKKKEV

SEQ ID NO: 350 - protein, 263 aa, Chlamydia pneumoniae
  CPn0348
EGWLLNVKDETFWSVHNLCVNYEHAAVLYHISFSLGKGSLTAILGPNGAGKSTLLKASLGLIKPSSGTVYFFNQKFKKVRQRIAYMPQRASVDWDFPMTVLDLALMGCYSYKGMWGRISSDDRREAFHILERVGLESVADRQIGQLSGGQQQRAFLARALMQKADLYLMDELFSAIDMASFKTSVGVLQELRDQGKTIVVVHHDLSHVRQLFDHVVLLNKRLICCGPTDECLNGDTIFQTYGCEIELLEQTLKLSRGKQFGSC

SEQ ID NO: 351 - protein, 336 aa, Chlamydia pneumoniae
  CPn0349
WILKNASREMDAKMGYIFKVMRWIFCFVACGITFGCTNSGFQNANSRPCILSMNRMIHDCVERVVGNRLATAVLIKGSLDPHAYEMVKGDKDKIAGSAVIFCNGLGLEHTLSLRKHLENNPNSVKLGERLIARGAFVPLEEDGICDPHIWMDLSIWKEAVIEITEVLIEKFPEWSAEFKANSEELVCEMSILDSWAKQCLSTIPENLRYLVSGHNAFSYFTRRYLATPEEVASGAWRSRCISPEGLSPEAQISVRDIMAVVDYINEHDVSVVFPEDTLNQDALKKIVSSLKKSHLVRLAQKPLYSDNVDDNYFSTFKHNVCLITEELGGVALECQR

SEQ ID NO: 352 - protein, 172 aa, Chlamydia pneumoniae
  CPn0350
EVGFMAVEQSHIKEEIEKLIGKAIKRVCGNKENDLCRYLPGPSGGYMHHFTLKKMKSAAPEQLLKMLKTFILESETPRTINPKPRAPRGSKKRRDFINFTKTDIERVLELARQVGDKDLLARFSPKKPLTSLKRELIRSIRNGIVSVELWNAYVEAVKAVSSPNLEVTSPFV

SEQ ID NO: 353 - protein, 524 aa, Chlamydia pneumoniae
  CPn0351
KIKVFQRVNMTKTEEKPFGKLRSFLWPIHTHELKKVLPMFLMFFCITFNYTVLRDTKDTLIVGAPGSGAEAIPFIKFWLVVPCAIIFMLIYAKLSNILSKQALFYAVGTPFLIFFALFPTVIYPLRDVLHPTEFADRLQAILPPGLLGLVAILRNWTFAAFYVLAELWGSVMLSLMFWGFANEITKIHEAKRFYALFGIGANISLLASGRAIVWASKLRASVSEGVDPWGISLRLLMAMTIVSGLVLMASYWWINKNVLTDPRFYNPEEMQKGKKGAKPKMNMKDSFLYLARSPYILLLALLVIAYGICINLIEVTWKSQLKLQYPNMNDYSEFMGNFSFWTGVVSVLIMLFVGGNVIRKFGWLTGALVTPVMVLLTGIVFFALVIFRNQASGLVAMFGTTPLMLAVVVGAIQNILSKSTKYALFDSTKEMAYIPLDQEQKVKGKAAIDVVAARFGKSGGALIQQGLLVICGSIGAMTPYLAVILLFIIAIWLVSATKLNKLFLAQSALKEQEVAQEDSAPASS

SEQ ID NO: 354 - protein, 451 aa, Chlamydia pneumoniae
  CPn0352
WVGIFFINSHFTNSYAFFNQKVIITVRHSGCTMKCSPLTLVPHIFLKNDCECHRSCSLKIRTIARLILGLVLALVSALSFVFLAAPISYAIGGTLALAAIVILIITLVVALLAKSKVLPIPNELQKIIYNRYPKEVFYFVKTHSLTVNELKIFINCWKSGTDLPPNLHKKAEAFGIDILKSIDLTLFPEFEEILLQNCPLYWLSHFIDKTESVAGEIGLNKTQKVYGLLGPLAFHKGYTTIFHSYTRPLLTLISESQYKFLYSKASKNQWDSPSVKKTCEEIFKELPHNMIFRKDVQGISQFLFLFFSHGITWEQAQMIQLINPDNWKMLCQFDKAGGHCSMATFGGFLNTETNMFDPVSSNYEPTVNFMTWKELKVLLEKVKESPMHPASALVQKICVNTTHHQNLLKRWQFVRNTSSQWTSSLPQYAFHAQTYKLEKKIESSLPIRSSL

SEQ ID NO: 355 - protein, 81 aa, Chlamydia pneumoniae
  CPn0353
LRFRNIKKSLIFIKRIRYSQSGKEQKGARPFFKKSITSSLVILLLEAIFNENFSSIIQNNFNKNFKNKNISINRIFVKFTI

SEQ ID NO: 356 - protein, 482 aa, Chlamydia pneumoniae
  CPn0354
YKTISIKILKIKTFLLIGFLLNLRYNTQIDEPRKCMSNITSPVIQNNRSCNYYFELKNSTTIHIVISAILLCGALIAFLCVAAPVSYILSGALLGLGLLIALIGVILGIKKITPMISSKEQVFPQELVNRIRAHYPKFVSDFVSEAKPNLKDLISFIDLLNQLHSEVGSSTNYNVSEELQQKIDTFEGIARLKNEVRTASLKRLESAASSRPLFPSLPKILQKVFPFFWLGEFISAGSKVVELHRVKKIGGSLEEDLSDYIKPEMLPTYWLIPLDFRPTNSSILNLHTLVLARVLTRDVFQHLKYAALNGEWNLNHSDLNTMKQQLFAKYHAAYQSYKHLSQPSLQEDEFYNLLLCIFKHRYSWKQMSLIKTVPADLWENLCCLTLDHTGRPQDMEFASLIGTLYTQGLIHKESEAFLSSLTLLSLDQFKTIRRQSTNIAMFLENLATHNSTFRSLPPITVHPLKRSVFSQPEEDESSLLIG

SEQ ID NO: 357 - protein, 455 aa, Chlamydia pneumoniae
  CPn0355
IRDFYLHIIYTAFNRSISKELAMSMTIVPHALFKNHCECHSTFPLSSRTIVRIAIASLFCIGALAALGCLAPPVSYIVGSVLAFIAFVILSLVILALIFGEKKLPPTPRIIPDRFTHVIDEAYGLSISAFVREQQVTLAEFRQFSTALLCNISPEEKIKQLPSELRSKVESFGISRLAGDLEKNNWPIFEDLLSQTCPLYWLQKFISAGDPQVCRDLGVPRECYGYYWLGPLGYSTAKATIFCKETHHILQQLTKEDVLLLKNKALQEKWDTDEVKAIVERIYTTYTARGTLKTEAGGLTKETISKELLLLSLHGYSFDQLQLITQLPRDAWDWLCFVDNSTAYNLQLCALVGALSSQNLLDESSIDFDVNLGLYVIQDLKEAVQAFSASDEPKKELGKFLLRHLSSVSKRLESVLRQGLHRIALEHGNARARVYDVNFVTGARIHRKTSIFFKD

SEQ ID NO: 358 - protein, 119 aa, Chlamydia pneumoniae
  CPn0356
KQVQLFQYMNESGWDWLCDFDSQGEGFQLSRLVGLLHSSWALYEAKEQFYLPEVSLLTWEELIEMQLLSKPTKHGVAKDLCNVFEKHFQRFRQYLGSLDLNQRFENTFLNYPKYHLDRE

SEQ ID NO: 359 - protein, 291 aa, Chlamydia pneumoniae
  CPn0357
YSSHNGASMVNIQPVYRNTQVNYSQATQFSVCQPALSLIIVSVVAAVLAIVALVCSQSLLSIELGTALVLVSLILFASAMFMIYKMRQEPKELLIPKKIMELIQEHYPSIVVDFIRDQEVSIYEIHHLISILNKTNVFDKAPVYLQEKLLQFGIEKFKDVHPSKLPNFEEILLQHCPLHWLGRLVYPMVSDVTPGTYGYYWCGPLGLYENAPSLFERRSLLLLKKISFGEFALLEDGLKKNTWSSSELVQIRQNLFTRYYADKEEVDEAELNADYEQFDSLLHLIFSHKLS

SEQ ID NO: 360 - protein, 60 aa, Chlamydia pneumoniae
  CPn0358
EEVLSVSMKLIPTQDSIERETDSKRDKKIFTIYICSSKVLAGHFFSHLDKHNKIHESIGV

SEQ ID NO: 361 - protein, 608 aa, Chlamydia pneumoniae
  CPn0359
ITLQYILKEYKIENIRNFSIIAHIDHGKSTIADRLLESTSTVEEREMREQLLDSMDLERERGITIKAHPVTMTYLYEGEVYQLNLIDTPGHVDFSYEVSRSLSACEGALLIVDAAQGVQAQSLANVYLALERDLEIIPVLNKIDLPAADPVRIAQQIEDYIGLDTTNIIACSAKTGQGIPAILKAIIDLVPPPKAPAETELKALVFDSHYDPYVGIMVYVRIISGELKKGDRITFMAAKGSSFEVLGIGAFLPKATFIEGSLRPGQVGFFIANLKKVKDVKIGDTVTKTKHPAKTPLEGFKEINPVVFAGIYPIDSSDFDTLKDALGRLQLNDSALTIEQESSHSLGFGFRCGFLGLLHLEIIFERIIREFDLDIIATAPSVIYKVVLKNGKVLDIDNPSGYPDPAIIEHVEEPWVHVNIITPQEYLSNIMNLCLDKRGICVKTEMLDQHRLVLAYELPLNEIVSDFNDKLKSVTKGYGSFDYRLGDYRKGSIIKLEVLINEEPIDAFSCLVHRDKAESRGRSICEKLVDVIPQQLFKIPIQAAINKKVIARETIRALSKNVTAKCYGGDITRKRKLWEKQKKGKKRMKEFGKVSIPNTAFIEVLKLD

SEQ ID NO: 362 - protein, 481 aa, Chlamydia pneumoniae
  CPn0360
VALQTNIGLIGLAVMGKNLVLNMIDHGFSVSVYNRTPEKTRDFLKEYPNHRELVGFESLEDFVNSLERPRKIMLMIQAGKPVDQSIHALLPFLEPGDVIIDGGNSYFKDSERRCKELQEKGILFLGVGISGGEEGARHGPSIMPGGNPEAWPLVAPIFQSIAAKVQGRPCCSWVGTGGAGHYVKAVHNGIEYGDIQLICEAYGILRDFLKLSATAVATILKEWNTLELESYLIRIASEVLALKDPEGIPVIDTILDVVGQKGTGKWTAIDALNSGVPLSLIIGAVLARFLSSWKEIREQAARNYPGTPLIFEMPHDPSVFIQDVFHALYASKIISYAQGFMLLGEASKEYNWGLDLGEIALMWRGGCIIQSAFLDVIHKGFAANPENTSLIFQEYFRGALRHAEMGWRRTVVTAIGAGLPIPCLAAAITFYDGYRTASSSMSLAQGLRDYFGAHTYERNDRPRGEFYHTDWVHTKTTERVK

SEQ ID NO: 363 - protein, 423 aa, Chlamydia pneumoniae
  CPn0361
SLAILNYVRSLMQSWLQSLQERNILENFTAGLESVEGPIAAYLGFDPTAPALHIGHWIGICFLKRLAALGITPIALVGGATGMVGDPSGKQSERSLLQTSEVFDNSQKITACLQRYLPGVTLVNNADWLQEISLIDFLGDIGKHFRLGQMLVKDTIKQRVHSDEGISYTEFSYLILQSYDFYHLFKNYGTILQCGGSDQWGNITSGIDFIRRKGLGQAYGLTYPLLTNAQGKKIGKTESGTVWLDSDLTSPFELYQYLLRLPDDTIPKIARTLTLLSNEEIQDIDRRVQTDPVAVKEFVAQDILSAIHGDLGLEEALSVTRSMHPGNLSSLSEKDFHELFAGGMGASLDKSEVLGKRWLDLFLVLGLCKSKGEIRRLIEQKGVYINNVPIANEHSVCEEQDICYGHYVLLAQGKKRKLVLYLN

SEQ ID NO: 364 - protein, 263 aa, Chlamydia pneumoniae
  CPn0362
LDKKKFVKTQQTQNIIEVWNFYWETQEIEYRDSLIEFYLPLVKSVVHRLISGMPSHVKTEDLYASGVEGLVRAVERYNPERSRRFEGYAVFLIKAAIIDDLRKQDWVPRSVHQKANKLSGAMDSLRQSLGKEPTDLELCEYLNISQQELSGWFVSARPALIVSLNEEWPSQSDEGAGMALEERIPDERAETGYDVVDKQEFSLCLANAIQELEEKERKVMALYYYEELVLKEIGKVLGVSESRVSQIHSKALLKLRAALSAFR

SEQ ID NO: 365 - protein, 586 aa, Chlamydia pneumoniae
  CPn0363
EAVFVSGKKDGVRGMIFVPLSILVLIFLPLPQILLDFGLCISFALSLLTVCWVFTLNSSNSAKLFPPFFLYLCLLRLGLNLASTRWIVSSGTASSLIVSLGSFFSLGSLWAATFACLLLFFVNFLMVSKGSERIAEVRSRFFLEALPAKQMALDSDLVSGRASYKAVKKQKNALIEEGDFFSAMEGVFRFVKGDAIISCILLLVNVVSVTCLYYTSGYALEQMWFTVLGDALVSQVPALLTSCAAATLISKIDKEESLLNYLFEYYKQLRQHFRVVSLLIFSLCCIPSSPKFPIVLLASLLWLAYRKEEPASEDSCIERAFSYVEGACPKEQESQFYQVYRAASEEVFEDLGVRLPVLTSLRIEERPWLRVFGQNVYLDEMTPEAVLPFLRNIAHEALNAEVVQKYLEESERVFGIAVEDIVPKKISLSSLVVLSRLLVRERVSLKLFPKILEAVAVYQNSGDSLEILAEKVRKSLGYWIGRSLWDQKQTLEVITIDFHVEELINSSYSKSNPVMQENVIRRVDSLLERSVFKDFRAIVTSCETRFEMKKMLDPHFPDLLVLSHDELPKEIPISFLGIVSDEVLVP

SEQ ID NO: 366 - protein, 95 aa, Chlamydia pneumoniae
  CPn0364
KENSMAKLVITSDDEQQEFELEDNSEIAEPCESMGIPFACTEGVCGTCVIEVLEGRENLSEFTEPEYDFLGEPEDSNERLACQCRIKGGCVKVTF

SEQ ID NO: 367 - protein, 349 aa, Chlamydia pneumoniae
  CPn0365
FKGTQVNSLIMATISPISLTVDHPLVDTKKKSCSNFDKIQSRILLITAIFAVLVTIGTLLIGLLLNIPVIYFLTGISFIAVVLSNFILYKRATTLLKPRACGKHKEIKPKRVSTNLQYSSISIAINRSKENWEHQPKDLQNLPAPSALLTDNPYEIWKAKHSLFSLVSLLPGGNPEHLLISASENLGKTLLIEETSQNAPISSYVDTTPSPKSLLNEAIQETRVEINTELPAGDSGERLYWQPDFRGRVFLPQIPTTPEAIYQYYYALYVTYIQTAINTNTQIIQIPLYSLREHLYSRELPPQSRMQQSLAMITAVKYMAELHPEYPLTIACVERSLAQLPQESIEDLS

SEQ ID NO: 368 - protein, 155 aa, Chlamydia pneumoniae
  CPn0366
MGYLPVSATDVLFESPAAPLINSANTQNQKLIELKGKQQAESSPRTITSVILEVLLVIGCCLIVLSLLAIRPALQFTLETGHPAAIAVLAVSGTILLVAVIILFCFLAAVPFAAKKTYKYVKTVDDYASWHSHQQTPTLGTIFSGIVYAESQAQL

SEQ ID NO: 369 - protein, 253 aa, Chlamydia pneumoniae
  CPn0367
SFPLNRYFMTKTTSIPDVHENQSHLSVDERLISESPVLTKKEVIAKIIKLTALILALAIAVGTAVVAGVLGMPLMAIATGAALLAAVVLSCLLLRRREPSKPTEELLGPQKHVPKDIAAQVQPSVPLDYQKLLRNEWTLVNTLSEINISWTLQDPNQRYYVWEHQGAPITLVATTGDIAKPRLKTSGRVMIVNAANSNMQSGGAGTNAALSAATHPTCWNNTRTSGGKINTGKGLSVGECRSAPWINRDWTNK

SEQ ID NO: 370 - protein, 114 aa, Chlamydia pneumoniae
  CPn0368
TLAKDYLWVNAAQHPGSIETGRINDTNPGEAHFLAQLLGPKYEGELKAHPEKLSNVIKKAYLNCFDEALNNQATVVQVPLISSSIYSPGGKLELEPVNQTKPNSSAYKLYHIRT

SEQ ID NO: 371 - protein, 406 aa, Chlamydia pneumoniae
  CPn0369
NIMTDSNPLPSYTDASLYRTPAKHSYPIRLPLNRTDRIEKILKIVTLTLALACALGFSIAAGILAMPIFSAVVVITLAIAAVSLYSLLKKPKLYEILPQIEPESEQSSLSPSPQPPEQQDLPLQIDPLPDPESLPEVSLADLTTPPEELTAITVTPGYEALLEQNWDLLPSLAAVDPSFTTETPQQPCFIWKLKDSKLIFISTSGDIAVPRIKTQGRVMIVNAANENISREGGGTNKALSLATSLQCWNASRLPRAHSRSGSQLQPGECRSAKWENSDHTSNDHVPGKAHFLAQLLGPEAAKCNNDPKQAFEVSKKAFHNLFQEAEIIGVDVIQLPLIGCNLFAPSRLLNLGKTRAEWIEAIKLALITSLQDFGWEQDNQEEQKIIILTDKDQPPIIPPRFDLTTP

SEQ ID NO: 372 - protein, 386 aa, Chlamydia pneumoniae
  CPn0370
KRIFFKLFVFYLKSFMSTTEPNLTNVNLTMLISSESMPTQLASHKLKGLDLVAFILIIGIAVSSGTAAIILGIPLLFILTALAVLAFSILLYFLLREPKSPISVTHQPTPIIKDTDLPPVPPLALTPVPTEAVLEEPPLPSPRTHQTLLQENWDRIPDLQANTDMPFIAADNQTGYAWHLKNSNLTLISTLGPIEKPRYKTQGIVMIVNAATPNMANNVKGTSLALAKATSVRCWENSKKSPDPLRSKQPLQLGECRSAKWENLNGTTNAGKAGLPQFLGQLLGPKASDYNYNPNDAFTFCRQAYLNCLNEAKRRKTTVVQLPLLSSHFPGSPKDEETTSLRLQWIDGVKLALIDALQTFGSEAENQNQPWVIILTTLARHPLITP

SEQ ID NO: 373 - protein, 121 aa, Chlamydia pneumoniae
  CPn0371
KTMPVSSAPLPTSHRPSSGNLGLMEPNSKALKAKHQDKTTKTIKLLVKILVAILVIEVLGIIAAFFIPGTPPICLIILGGLILTTVLCVLLLVIKLALVNKTEGTTAEQQIKRKLSSKSIS

SEQ ID NO: 374 - protein, 117 aa, Chlamydia pneumoniae
  CPn0372
NYRACHRNIGNHMSSPVVTGTSSASPVEQTKLGEFLERLSGSGRCIKIAFAASTALLLLNTFVSGIVAIAMIFVATSVGAYFTVIGPLFLLSLILLAIMLISMYKITHPSQNTPISN

SEQ ID NO: 375 - protein, 621 aa, Chlamydia pneumoniae
  CPn0373
NSEIFEIFMTLITPAINSSRRKTHTVRIGNLYIGSDHSIKTQSMTTTLTTDIDSTVEQIYALAEHNCDIVRVTVQGIKEAQACEKIKERLIALGLNIPLVADIHFFPQAAMLVADFADKVRINPGNYIDKRNMFKGTKIYTEASYAQSLLRLEEKFAPLVEKCKRLGKAMRIGVNHGSLSERIMQKYGDTIEGMVASAIEYIAVCEKLNYRDVVFSMKSSNPKIMVTAYRQLAKDLDARGWLYPLHLGVTEAGMGVDGIIKSAVGIGTLLAEGLGDTIRCSLTGCPTTEIPVCDSLLRHTKIYLDLPEKKNPFSLQHSENFVSAAEKPAKTTLWGDVYGVFLKLYPHHLTDFTPEELLEHLGVNPVTKEKAFTTPEGVVVPPELKDAPITDVLREHFLVFHHHQVPCLYEHNEEIWDSPAVHQAPFVHFHASDPFIHTSRDFFEKQGHQGKPTKLVFSRDFDNKEEAAISIATEFGALLLDGLGEAVVLDLPNLPLQDVLKIAFGTLQNAGVRLVKTEYISCPMCGRTLFDLEEVTTRIRKRTQHLPGLKIAIMGCIVNGPGEMADADFGFVGSKTGMIDLYVKHTCVKAHIPMEDAEEELIRLLQEHGVWKDPEETKLTV

SEQ ID NO: 376 - protein, 251 aa, Chlamydia pneumoniae
  CPn0374
VDSMTLSFHTHPLNYWTFEEFDGLPIRHGVFSKQKDAEGTVFAAKNPEIASALQSPKYCDLHQRHGTSVRCVTPTSPTYQPADGLCTQSPLLSLHIRHSDCQAAIFYDREHHAIANVHSGWRGLLGNIYAVTVGTMKKLFHTKPQDLFVAIGPSIGPDYAIYPDYATLFPRSFLPFMNPKNHFDLRAIARKQLTNLGISKDRIFISDLCTYTEHDAFFSSRYLAHHPDPNLTGQHSKNRNNVTAVLLLPRD

SEQ ID NO: 377 - protein, 168 aa, Chlamydia pneumoniae
  CPn0375
RLSMKLGASTNHKVHEPVKPKKAQLAEIEANKTQATEGTLRSKSLALQIARAVLYILFAALMLAAGITFVTFLALGFPLIQAYSIAGIITLVGLAIGLVLLILSLLPKEDEEADALSRNALLPLTIIVIEQQPITPKPEIPYSYLTKLALLTSLFLTLRRSSSQRKTH

SEQ ID NO: 378 - protein, 205 aa, Chlamydia pneumoniae
  CPn0376
FKVVTAKAPNLTEIRDHGARVPSLFLLSPETSHWKGDKEVSAPLKQLQDLLGEEQWEAMKTKMNSRKKAGQWAIFNSPTPGVSSTLVLAWTPWGYYDKDVQDILERKDPMSSSLSEKDSKEFLKNLFVDLLENGFTSVHIHAEEAFTPLDHTGKPHFKRDNVYLPGKLLGALNEAAVQANVSADTQFTLFLTQDECNPFHDKKRG

SEQ ID NO: 379 - protein, 365 aa, Chlamydia pneumoniae
  CPn0377
IMTTEVRIPNIAESISEVTVASLLVTEGALIQENQGLLEIESDKVNQLIYAPVSGRIFWEVSEGDVVPVGGVVGKIEPAGEGEELGDSQSKETIEAEIICFPQSGVRQSPPENKTFIPLRDQMDQGSQGLSAGDRGETRERMTSIRKTISRRLLSALHESAMLTTFNEVYMTPLFHLRKEKQEEFLSRYGVKLGFMSFFVKAVLEALKAYPRVNAYIDGEEIVYRHYYDISIAVGIDRGLVVPVIRDCDKLSNGEIEQKLADLALRAREGLLAIAELEGGGFTITNGGVYGSLLSTPIINPPQVGILGMHKIEKRPVVLDNEIVIADMMYVALSYDHRLIDGKEAVGFLVKVKEGLENPASLLDL

SEQ ID NO: 380 - protein, 917 aa, Chlamydia pneumoniae
  CPn0378
IVFIEFNYFMDSEFVGQVYSSDMDWIESMYQRFMNHETLDPSWKYFFEGYQLGQAASPSEASTKISGNETIAMLQEQKSQFLCTIYRYYGYLQSQISTLAPTTDSRFIQEKIAKIDLDEQVPSAGLLPKAQVSVRELIEALKKCYCGSLTLETLTCTPELQEFVWNLMEKRQVERFAEQLLRSYKDLCKATFFEEFLQIKFTGQKRFSLEGGETLVPMLEHLVHYGSALGISNYVLGMAHRGRLNVLTNVLGKPYRYVFMEFEDDPAARGLESVGDVKYHKGYVLKSHQKDRETTFVMLPNASHLESVDPIVEGVVAALQHQGHAGKEQSSLAILVHGDAAFSGQGVVYETLQLSRVPGYSTEGTLHIVVNNYIGFTAVPRESRSTPYCTDIAKMLGIPVFRVNSEDVVACIEAIEYALQVRERFSCDVIIDLCCYRKYGHNESDDPSVTAPLLYDQIKRKKSIRELFRQYLLEGQFADISEETLASIEKEIQESLNREFQVLKGTDPEPFPKKECHHCDRLNNGELILHDCDVSLDRETLFHMSSRLCGFPDNFHPHPKIKTLLEKRMKMAEGGVGYDWAMAEELAFASLLIEGYNLRLSGQDSIRGTFSQRHLVWSDTVTGDTYSPLYHLSAEQGSVEMYNSPLSEYAILGFEYGYAQQALKTLVLWEAQFGDFANGAQIIFDQYISSGIQKWDLHSDIVLLLPHGYEGQGPEHSSSRIERYLQLAANWNFQVVLPSTPVQYFRILREHAKRDLSLPLVIFTPKLLLRYPQCVSSIEEFTEPGGFRAILEDADPNYDASILVLCSGKIYYDYAEMLPQDRRKDFSCLRIESLYPLALEDLVSLIDKYSHLKHFVWLQEESKNMGAYDYMFMALQDILPEKLLYIGRPRSSSTASGSAKLSRQELVTCMETLFSLR

SEQ ID NO: 381 - protein, 166 aa, Chlamydia pneumoniae
  CPn0379
KNKKMLCTCSRIQDGNPWMKSERLKKLESELHDLTQWMQLGLVPKKEISRHQEEIRILEHKIYEEKERLQLLKENGEIEEYVTPRRSPAKTVYPDGPSMSDIEFVEPTETEIDIDPGETVELELTDEGREDGAVEVDYSHEDDEDPFSDRNRWRRGGIIDPDANEW

SEQ ID NO: 382 - protein, 402 aa, Chlamydia pneumoniae
  CPn0380
KSTIPTKTMKTLSAIAIAGDAVVSLIPMLMNGKAPLALYIHIPFCTKKCRYCSFYTIPYKSESVSLYCNAVIQEGLRKLAPIQETHFIETVFFGGGTPSLVSPLDLKRILKELAPHAREITLEANPENLTVSYLRQLQETPINRISVGVQTFDDSILQLLGRTHSSSAAITALQECQNHGFSNLSIDLIYGLPTQSLEIFLSDLHQALTLPITHISLYNLTIDPHTSFYKHRKILVPTIAQEEILAEMSLLAENLLLSQGFQRYELASYAKPDYPAKHNLYYWTDRPFLGLGVSASQYLHGERSKNYSHISHYLRAVRKNLPTQETSEILPKKERIKEALALRLRLLEGADLAEFPSTLISMLTQDVKLQNLFSVHGQCLALNRQGRLFHDTIAEEIMGYSF

SEQ ID NO: 383 - protein, 600 aa, Chlamydia pneumoniae
  CPn0381
SLPNKFRALMTAPTESRSSPPTLLEETEPLSPNPIPADIQIPRITISPPSLDVSTVASSAEDISVFIAGGPRSSSSASVASDVYELVCLCGGDEDPEPPDSEVRTLYVNGSWQTHQEAVQELLYISEVRGEAVRLLYNDGSGMSPWPISPCRTLPTLDHPLCQALLTVWEQFFSAPENQNREFLVIFYGDASPYIQQALTQSRHSPRIVVVGISPTVFIQGDFRVHNYRVSGDFFSSLDCRGTRAENTTILPYSSGLEGVFLPSIRCPSFTWAVRFGEQCLVANRGEDVEDRGGLSQDAERSQLPHSERDLAVVIDSTDPSSMSRLVEWLNQGSPSSDMEINPYPQRCPDVALSALYAISRVSGLAQEWILASVHEGLDLQICYSLILMHTTFAVRYFFLLFTNYPQSRERFRTARIVAQSLYLPSILVLVFDCGNVLRKLWMPQEILRAIFISASTISGSIVFVECTRWMGRGLRHRVQQFVQQRVIGSGLPVGTVRASYRDRAGFIIGFLQTVHGGLYLPVSIMVLNQIAIQVPRILVRPNNTAVYDLHNKSAEENWSSGDVLAVGQTLNFILCAFVLFVNLWFFVKSVLRHSRRRRR

SEQ ID NO: 384 - protein, 239 aa, Chlamydia pneumoniae
  CPn0382
PVTLYLLPNTLGTRAVETLPSVIGELVHRLDGLIVESDRGGRAFLSLWKIPEVHKFPLAILSKHARLPKAWDFYLEPIVKHGENWGLISDAGLPCIADPGASLVRRARALGIPVQAFSGPCSITLALMLSGLPSQSFTFLGYLPQSPKERVKSIKKAATSKEVSTSVCIETSYRNVYTFESLLDTLPSYAELCVASDLSGPSELVLTRQVQSWRTTEDLGSVKQSITKVPTIFLFHIPN

SEQ ID NO: 385 - protein, 321 aa, Chlamydia pneumoniae
  CPn0383
VQDTTFLTLPMQKSLTSFDDFSQAYAEKVPAIALIGSALEDDKDALIELLVSESFKELGGQGLMPATLMSWTETFALFQEHETLGIIHAEKFPLATKEFLSRYARNPQPHLTILIFTTKQECFRELSKALPSALSLSLFGEWPADRQKRIIRLLLQRAERVGISCSQSLASLFLRALASTSLPDILSEFDKLLCSVGKKTSLDHSDIKELVVKKEKASLWKFRDSLLKRDPVEGHQQLHFLLEDGEDPLGIITFLRTQCLYGLRSIEEGSKENKHRMFVLYGKERLHQALNSLFYAETLIKNNVQDPIVAVETLVIRMVNL

SEQ ID NO: 386 - protein, 182 aa, Chlamydia pneumoniae
  CPn0384
VITCLIRGIKMIGAQKKQSGKKTASRAVRKPAKKVAAKRTVKKATVRKTAVKKPAVRKTAAKKTVAKKTTAKRTVRKTVAKKPAVKKVAAKRVVKKTVAKKTTAKRAVRKTVAKKPVARKTTVAKGSPKKAAACALACHKNHKHTSSCKRVCSSTATRKHGSKSRVRTAHGWRHQLIKMMSR

SEQ ID NO: 387 - protein, 507 aa, Chlamydia pneumoniae
  CPn0385
FLVIKGEFVVLFHAQASGRNRVKADAIVLPFWHFKDAKNAASFEAEFEPSYLPALENFQGKTGEIELLYSSPKAKEKRIVLLGLGKNEELTSDVVFQTYATLTRVLRKAKCSTVNIILPTISELRLSAEEFLVGLSSGILSLNYDYPRYNKVDRNLETPLSKVTVIGIVPKMADAIFRKEAAIFEGVYLTRDLVNRNADEITPKKLAEVALNLGKEFPSIDTKVLGKDAIAKEKMGLLLAVSKGSCVDPHFIVVRYQGRPKSKDHTVLIGKGVTFDSGGLDLKPGKSMLTMKEDMAGGATVLGILSALAVLELPINVTGIIPATENAIDGASYKMGDVYVGMSGLSVEICSTDAEGRLILADAITYALKYCKPTRIIDFATLTGAMVVSLGEEVAGFFSNNDVLAEDLLEASAETSEPLWRLPLVKKYDKTLHSDIADMKNLGSNRAGAITAALFLQRFLEESSVAWAHLDIAGTAYHEKEEDRYPKYASGFGVRSILYYLENSLSK

SEQ ID NO: 388 - protein, 166 aa, Chlamydia pneumoniae
  CPn0386
KSKGYLMMFGHFAGYLGADPEERMTSKGKRVITLRLGVKTRVGMKDETVWCKCNIWHNRYDKMLPYLKKGSGVIVAGDISVESYMSKDGSPQSSLVISVDSLKFSPFGRNEGSRSPSLEDNHQQVGYESVSVGFEGEALDAEAIKDKDMYAGYGQEQQYVCEDVPF

SEQ ID NO: 389 - protein, 177 aa, Chlamydia pneumoniae
  CPn0387
NNNNLLQGDSLMSRQNAEENLKNFAKELKLPDVAFDQNNTCILFVDGEFSLHLTYEEHSDRLYVYAPLLDGLPDNTQRKLALYEKLLEGSMLGGQMAGGGVGVATKEQLILMHCVLDMKYAETNLLKAFAQLFIETVVKWRTVCADICAGREPSVDTMPQMPQGGGGMQPPPTGIRA

SEQ ID NO: 390 - protein, 666 aa, Chlamydia pneumoniae
  CPn0388
STMEKVSSYPSVPLPLGASKISPNRYRFALYASQATEVILALTDENSEVIEVPLYPDTHRTGAIWHIEIEGISDQSSYAFRVHGPKKHGMQYSFKEYLADPYAKNIHSPQSFGSRKKQGDYAFCYLKEEPFPWDGDQPLHLPKEEMIIYEMHVRSFTQSSSSRVHAPGTFLGIIEKIDHLHKLGINAVELLPIFEFDETAHPFRNSKFPYLCNYWGYAPLNFFSPCRRYAYASDPCAPSREFKTLVKTLHQEGIEVILDVVFNHTGLQGTTCSLPWIDTPSYYILDAQGHFTNYSGCGNTLNTNRAPTTQWILDILRYWVEEMHVDGFRFDLASVFSRGPSGSPLQFAPVLEAISFDPLLASTKIIAEPWDAGGLYQVGYFPTLSPRWSEWNGPYRDNVKAFLNGDQNLIGTFASRISGSQDIYPHGSPTNSINYVSCHDGFTLCDTVTYNHKHNEANGEDNRDGTDANYSYNFGTEGKTEDPGILEVRERQLRNFFLTLMVSQGIPMIQSGDEYAHTAEGNNNRWALDSNANYFLWDQLTAKPTLMHFLCDLIAFRKKYKTLFNRGFLSNKEISWVDAMGNPMTWRPGNFLAFKIKSPKAHVYVAFHVGAQDQLATLPKASSNFLPYQIVAESQQGFVPQNVATPTVSLQPHTTLIAISHAKEVT

SEQ ID NO: 391 - protein, 312 aa, Chlamydia pneumoniae
  CPn0389
TVFNFKRFYQKDSQRQNGNTTCLRPFKKTCKELIEFRRRTVKLLKNVLLGLFFSMSISGFSEVKVSDTFVKQDTVVEPKIRVLLSNESTTALIEAKGPYRIYGDNVLLDTAIQGQRCVVHALYEGIRWGEFYPGLQCLKIEPVDDTASLFFNGIQYQGSLYVHRKDNHCIMVSNEVTIEDYLKSVLSIKYLEELDKEALSACIILERTALYEKLLARNPQNFWHVKAEEEGYAGFGVTKQFYGVEEAIDWTARLVVDSPQGLIIDAQGLLQSNVDRLAIEGFNARQILEKFYKDVDFVVIESWNEELDGEIR

SEQ ID NO: 392 - protein, 346 aa, Chlamydia pneumoniae
  CPn0390
RKSDREGSYMTHQVAVLHQDKKFDVSLRPKGLEEFYGQHHLKERLDLFLCAALQRGEVPGHCLFFGPPGLGKTSLAHIVAYTVGKGLVLASGPQLIKPSDLLGLLTSLQEGDVFFIDEIHRMGKVAEEYLYSAMEDFKVDITIDSGPGARSVRVDLAPFTLVGATTRSGMLSEPLRARFAFSARLSYYSDQDLKEILVRSSHLLGIEADSSALLEIAKRSRGTPRLANHLLRWVRDFAQIREGNCINGDVAEKALAMLLIDDWGLNEIDIKLLTTIIDYYQGGPVGIKTLSVAVGEDIKTLEDVYEPFLILKGFIKKTPRGRMVTQLAYDHLKRHAKNLLSLGEGQ

SEQ ID NO: 393 - protein, 64 aa, Chlamydia pneumoniae
  CPn0391
KDQLYKQEKPIPKATILSRNLEVMLDNPKGKRQTLFLGRTSGRSALYSYSRRILVLLNAFMRGP

SEQ ID NO: 394 - protein, 190 aa, Chlamydia pneumoniae
  CPn0392
MSIKEDKWIREMALNADMIHPFVNGQVNVNEETGEKLISYGLSSYGYDLRLSREFKVFTNVYNSVVDPKCFTEDIFISITDDVCIVPPNSFALARSVEYFRIPRNVLTMCIGKSTYARCGIIVNVTPFEPEWEGHVTIEISNTTPLPAKIYANEGIAQVLFFESSTTCEVSYADRKGKYQKQQGITVPCV

SEQ ID NO: 395 - protein, 165 aa, Chlamydia pneumoniae
  CPn0393
KFLTLRHCQRKFTLMKGLPRSYSLSLVRPARFLMQTEKESIKSNKASPYLVSKVSVRKKNWGFRLLEEVMIKSWWVIFSILIGGFVYDRAIQELRTEELRLQSKVSSLCQDILSAQEKQRQLQLHLQHWQDSAAIEAALIQRLGLIPKGYKKLCVSPKQQSENKD

SEQ ID NO: 396 - protein, 414 aa, Chlamydia pneumoniae
  CPn0394
KETMIPTMLMFFIICFTLCSGFISLSQIALFSLPTSLISHYKRSKSKKQQRVATLLLHPHHLLITLIFCDIGLNIAIQNCFAILFGDAASWWFTVGLPLAITLILGEILPKAVALPFNTQIASSVAPLILCVTKIFKPLLHWGIVGINYVVQWILSKQQIDIIQPQELKEVLQSCKDFGVVNQEESRLLYGYLSLSDCSVKERMQPRQDILFYDIQTPLENLYLLFSKQHCSRVPICNDNLQNLLGICTARSLLLHDKPLQSSDDLLPLLKKPYYMPETISAKMALCQMAAEDETLGMIIDEYGSIEGLITQEDLFEIVAGEIVDQRDNKILYTTSGADVIIASGTLELREFSEIFDINLPTNNNIATIGGWLIEQIGTIPTTGMKLSWNNLLFQVLDAAPNRIRRVYIRKLYD

SEQ ID NO: 397 - protein, 407 aa, Chlamydia pneumoniae
  CPn0395
GNCMTNSALFWIGVNIICIVLQGFYSMMEMACVSFNRVRLQYYLTKDHKKARYINFLIRRPYRLFGTVMLGVNIALQVGSESSRNCYRALGITPDYAPFTQIFIVVIFAELLPLTISRKIPEKLALWGAPILYYSHYIFYPLIQLIGSLTEGLYYLLNIRKEKLNSTLSRDEFQKALETHHEEQDFNTIATNIFSLSATCADQVCQPLEQVTMLPSSANVKDFCRTIKNTDINFIPVYHKARKNVIGIAHPKDFVNKALDEPLINNLHSPWFITAKSKLIRILKEFRDNRSSVAVVLNASGEPIGILSLNAIFKILFNTTNIAHLKPKTISVIERTFPGNSRIKDLQKELDIQFPQYPVETLAQLVLQLLDSPAEVGTSVIINNLLLEVKEMSLSGIKTVSIKNLLS

SEQ ID NO: 398 - protein, 373 aa, Chlamydia pneumoniae
  CPn0396
YSMIYLDNNAMTPPERGLLEFLQKTFLIEGTYANPSSVHQLGKKSRQLVLEASHWMQKVLSFQGRVLYTSGATESLNLAIASLPKDSHVITSGSEHPAILEPLKHSSLSVSYLNPEEGRCVLTIEQIERAVTPKTSAIILGWVNSETGAKADIAAIAHFAQERQLQFIVDATANVGKERIVLPSGVTMAAFSGHKFHALSGIGALLVSPGVKLHPQLWGGGQQGGLRAGTENLWGIASLLYIFKYLDLHQERISQEILTHRNGFEKAIKARIPDVHIHCADQPRANNVSAIAFPPLEGEVLQIALDIEGVACGYGSACSSGATAPFKSLVSMGVDEELTLATLRFSFSHLLLQEDVERAVGIIEKVVERLKNS

SEQ ID NO: 399 - protein, 248 aa, Chlamydia pneumoniae
  CPn0397
EHFVDFDYFGLSDIGRVRARNEDFWQVNLMSQVVAIADGVGGRLGGDIASQEAVTSLMELIDEQQSKLMGYGDDQYKETLKKILLEVNGVVYEHGQMEEHLQGMGTTLSFIQFRKDRAWLFHVGDSRIYRIREGELRRLTEDHSLENQLKNRYGLPKQSDKVYSYRHILTNVLGSRPYVMPDIRNLPCEKEDLYCLCSDGLTNMVPDIDIRDILNQPATLEERGNALISLANTRGGDDNATVVLVRIQ

SEQ ID NO: 400 - protein, 61 aa, Chlamydia pneumoniae
  CPn0398
IEELPMQIENSSILFAEVVMKWFIFSVISAPVVFLPGCTLIPKEKVTKVPSQLWSESLSQP

SEQ ID NO: 401 - protein, 255 aa, Chlamydia pneumoniae
  CPn0399
YKLMRVLNGKSLNCESIDLKSKNFPRARIFCKISNLRTVTMRKMLVLLASLGLLSPTLSSCTHLGSSGSYHPKLYTSGSKTKGVIAMLPVFHRPGKSLEPLPWNLQGEFTEEISKRFYASEKVFLIKHNASPQTVSQFYAPIANRLPETIIEQFLPAEFIVATELLEQKTGKEAGVDSVTASVRVRVFDIRHHKIALIYQEIIECSQPLTTLVNDYHRYGWNSKHFDSTPMGLMHSRLFREVVARVEGYVCANYS

SEQ ID NO: 402 - protein, 260 aa, Chlamydia pneumoniae
  CPn0400
SKEMSKFILLLSLGVAALASKNFFIWPAPSGKTPLKLRQVLFGGALLVFSSLVALSVSSQTAELLSTMTGISLAFAFLFYLLFLPKDITRAILFSGERPVKTSWRALGSAIRMWIIIIPVTQLIGIMMSKFLTLVLPTQEIHTQEVTQEVQNSLPITGHYISMILNLGVLTPFGEEVFFRGILQTFLKNKMTRIAAVLCSSIIFSFIHIEHSLGSWVFVPVLFVFSLSAGFLYEKDRHILSPIALHGLFNLTSLLFLGIK

SEQ ID NO: 403 - protein, 130 aa, Chlamydia pneumoniae
  CPn0401
MRDHAFSKLIGTVRAMVVEGRCPWSLQQSLVSMVEHILGECQEFHEAVLQGKTVQEVGSEAGDVLTLVLILCFLLEREGVLASEDVANEAMEKLRRRAPYIFAEDYKPVSIEEADRLWELAKHREKNEST

SEQ ID NO: 404 - protein, 375 aa, Chlamydia pneumoniae
  CPn0402
NFKRFCMTKIAFSEKAKNFPVEALKKWFEKNKRSLPWRDNPTPYSVWVSEVMLQQTRAEVVIDYFNQWMERFPTIESLAAAKEEDVIKLWEGLGYYSRARHLLEGARMVMEEFHGKIPDDAISLAQIRGVGPYTVHAILAFAFKRRAAAVDGNVLRVLSRIFLIETSIDLESTRTWVSRIAQALLPHKSPEVIAEALIELGACICKKVPQCHRCPVRQACGAWRENKQFVLPVRHARKKVIFLHRLVAIVLYDGSLVVEKRRPKEMMAGLYEFPYIEVEPEEGLQDIEGFTKKMELSLESPLEFLGNLKEQRHAFTNHKVHLCPIIFKATSLPQFGELHLLSDIDHLAFSSGHKKIKDALLIYLGDVRSRESIGV

SEQ ID NO: 405 - protein, 234 aa, Chlamydia pneumoniae
  CPn0403
NFMQLSNDKRAALQYFMENFSWLATQVSRLSSFLRSQLPNHSKQEILASIRQHRCRVNGFIERFESYKVQPGDRVSLSLIPSTKQQPSILWEDDYSIIYEKPPHLTTEQMAHMTRFFTVHRLDKGTSGCLLMGKSKQAATELMKLFKQRKIHKQYIAFVFGHPKKKFGTVKSYTAPVYRRCGAVIFGAAGPSQGEPIKSAYKWDCWVILLSEMSTTDLKNSLPRSSALSSMLTP

SEQ ID NO: 406 - protein, 364 aa, Chlamydia pneumoniae
  CPn0404
ELEALEQKYGKAVLLIALSELGIDTMSLLSGHRLEGFPPIAEVMAACDRCSMDFCEILKSQSMDLWADAASCVDGLLQDPFWSTAIASGIAKSSLQETEFECESKVMVLSSWGEQGAQVCSPFNLERICMSFPSLKVFSLKKNGCENMGIQLSASCMNLLMSIFFVATNGGSTPIWITKENLMALVALVLSHYQCYFVPATGDPQRGNILGNPEVNAILARGMGMRVDLERKRGGESSSSRYLELAARCFENSLTKTSLLSDANNVQERDKCLLQMSTSLMHTAGLNLQRPPVPTPSGVTAHPQPQPDPVVTSQPSLLGARERSPVSSRGRFPVVLPLSVISPRSHPGRVERRDLEDEEEEVMF

SEQ ID NO: 407 - protein, 283 aa, Chlamydia pneumoniae
  CPn0405
NIQTSHSRVLLKKFSKEFTIRTYRSLGFTDYLGGCLTNPLGKFPSPQNPQVVTIAPSSTTPQAVSSAVQGFLQTGGAASSTATTTTASGASALGLSPDQVQALLTNLLNVGQPSVGQPSTSAGTSGASSSSASMQQQLLQLILDKTTGSGGSSVSSEQLQQLLSLVSQMTTSQGGSGGTQAGQAASVLLNLLSATGSAAANPLGTAASLAQIIYAAVTSPGAKKTSEFCYNYCGETCQGNCGCPTCGCPDGQCGCGGFGRFFCGVWKNCCGIGEGSQEPAIPL

SEQ ID NO: 408 - protein, 302 aa, Chlamydia pneumoniae
  CPn0406
GGFMLKIDLTGKVAFVAGIGDDQGYGWGIAKLLAEAGATIIVGTWVPIYKIFSQSWELGKFNESRKLSNGTLLEIAKIYPMDASFDSPEDVPEDIAENKRYKGITGFTISEVAEQVKKDFGHIDILVHSLANSPEISKSLLETSRKGYLAALSASSYSFVSLLSHFGSIMNRGGSTISLTYLASMRAVPGYGGGMSSAKAALESDTKTLAWEAGRRWGIRVNTISAGPLASRAGKAIGFIERMVDYYQEWAPIPEAMNAEQVGAVAAFLASPLASAITGETLYVDHGANVMGIGPEMFPKDS

SEQ ID NO: 409 - protein, 300 aa, Chlamydia pneumoniae
  CPn0407
NYGDAMEKLLVTDIDGTITHQSHHLDKKVYERLYALHQAGWKLFFLTGRYYKYAARLFSDFDAPYLLGCQNGASVWSSTSSNLLYSKSLPSDLLCILQDCMEGATALFSVESGAPYGDHYYRFSPTPIAQDLHEYVDPRYFPNAKEREILFETRSLKDDYAFPSFAAAKVFGLRDEVIRIQKELERQEALTSVATMTLMRWPFDFRYAILFLTDKSVSKGKALDRVVNILYDGKKPFVMASGDDANDLDLIERGDFKIVMSSAPEEMHVHADFLAPPADKNGILSAWEAGVRYYDDLMSL

SEQ ID NO: 410 - protein, 164 aa, Chlamydia pneumoniae
  CPn0408
SRVLHMFFNLFSLVFKLSDELALAETIQEPISVHEMFPGSMKLEMFKMLGSLILLLTIFGFGVWAFKKFVRSRSHGFGGSSQIKILERRSLTPKTSIYLIRVVNKTLVIAETPEKITLLTEFPPDTDINHLLQENNKQSSSSATSDFLSKAIQKIQKKQQTNQD

SEQ ID NO: 411 - protein, 161 aa, Chlamydia pneumoniae
  CPn0409
MTTWTLNQNNLTKFLKSSDEEPFLERESGLTYINIQANGNELPLFFVIRSEGEILQLICYLPYQLHESHKASTARLLHLLNRDIDIPGFGMDEEQGLIFYRLVLPCLNGEIHDTLLRIYIDTIKLVCDSFSHAIGLISSGNMNLDELRRQALQEQQEKRNE

SEQ ID NO: 412 - protein, 249 aa, Chlamydia pneumoniae
  CPn0410
DVRLFKSNKKNVMSSQTMDVLIFYDTETTGTQIERDRIIEIAAYNSVTDESFLTYVNPEIPIPDEASKIHGITTDAVLSAPKFPEAYEGFRKFCGEDSILVAHNNDGFDFPLLGKECRRHSLEPLTNRTIDSLKWAQKYRPDLPKHNLQYLRQVYGFAENQAHRALDDVVILHKVFTSLIGDLPPQQVLDLLQQSYHPKVFKMPFGKYKGQPLVDIPKSYFEWLENQGALDKPENKDIKAAIALLHQPT

SEQ ID NO: 413 - protein, 272 aa, Chlamydia pneumoniae
  CPn0411
RHQSRYSSITSTDMILTAAFSPCPNDIFLFRSFLKDPQFRPLLNQVTIADIETLNTLALQRRLSLMKMSAALFPLVSDYYNLMDVGNTLGYNSGPIVLSLDPECSLDTLATPGEMTTAHALCKLYYPKAKLIPMPYDKILSAILQGKVDGGALIHEERFSYDLQLTLRADFGELWRRKTIFPLPLGCLAIAKYVPMATVDALTAALRKSLICSLKDPITAGAKAVEYSKNKNVTVIHRFIGTYINKETFQLSKTGKKALHMLWKANECCQYT

SEQ ID NO: 414 - protein, 244 aa, Chlamydia pneumoniae
  CPn0412
EPISTKKPFNYLKLGKKLYICSGRPMNAVNTPKKILCIVADYREISPLIEQLDFTQINEHLYSYRCTDYHLDLYIVHVWGSTAVLNALQSYCQAYTDYDLWINPGFVGACSPEIPLGQCYTIEKIANLTTDTPPVLSEDPPYIFDALPDSLPKSSLVTSPVLYHYGFHKTFKLLDMEGYAIASQAAEHHIPCSFLKITSDYTVPGDCPFSRLEEVSQKLTQTLVELLPELMERAIPPKLLLPCP

SEQ ID NO: 415 - protein, 661 aa, Chlamydia pneumoniae
  CPn0413
VFMKLLLKAVLRHKNHLVILGCSLLAILGLTFSSQMEIFSLGMIAKTGPDAFLLFGRKESGKLVKVSELSQKDILENWQAISKDSETLTVSDATTYIAEHGKSTASLTSKLSKFVRNYIDVSRFRGLAIFLICVAIFKAVTLFFQRFLGQVVAIRVSRDLRQDYFKALQQLPMTFFHDHDIGNLSNRVMTDSASIALAVNSLMINYIQAPITFILTLGVCLSISWKFSILICVAFPIFILPIVVIARKIKNLAKRIQKSQDSFSSVLYDFLAGVMTVKVFRTEKFAFTKYCEHNNKISALEEKSAAYGLLPRPLLHTIASLFFAFVVVIGIYKFAIPPEELIVFCGLLYLIYDPIKKFGDENTSIMRGCAAAERFYEVLNHPDLHSQKEREIEFLGLSNTITFENVSFGYQEDKHILKNLSFTLHKGEALGIVGPTGSGKTTLVKLLPRLYEVSQGKILIDSLPITEYNKGSLRNHIACVLQNPFLFYDTVWNNLTCGKDMEEEAVLEALKRAYADEFILKLPKGVHSVLEESGKNLSGGQQQRLAIARALLKNASILILDEATSALDAISENYIKNIIGELKGQCTQIIIAHKLTTLEHVDRVLYIENGQKIAEGTKEELLQTCPEFLKMWELSGTKEYNRVFVPDHKLVANPTDMAITT

SEQ ID NO: 416 - protein, 344 aa, Chlamydia pneumoniae
  CPn0414
LCLRIVCIKMILFIRGEHILMELLPHEKQVVEYEKAIAEFKEKNKKNSLLSSSEIQKLEKRLDKLKEKIYSDLTPWERVQICRHPSRPRTVNYIEGMCEEFVELCGDRTFRDDPAVVGGFVKIQGQRFVLIGQEKGCDTASRLHRNFGMLCPEGFRKALRLGKLAEKFGLPVVFLVDTPGAYPGLTAEERGQGWAIAKNLFELSRLATPVIIVVIGEGCSGGALGMAVGDSVAMLEHSYYSVISPEGCASILWKDPKKNSEAASMLKMHGENLKQFGIIDTVIKEPIGGAHHDPALVYSNVREFIIQEWLRLKDLAIEELLEKRYEKFRSIGLYETTSESGPEA

SEQ ID NO: 417 - protein, 434 aa, Chlamydia pneumoniae
  CPn0415
SQTGFLPGLTLIFVIIIVWCNAFLIKLCVIMGLQSRLQHCIEVSQNSNFDSQVKQFIYACQDKTLRQSVLKIFRYHPLLKIHDIARAVYLLMALEEGEDLGLSFLNVQQYPSGAVELFSCGGFPWKGLPYPAEHAEFGLLLLQIAEFYEESQAYVSKMSHFQQALFDHQGSVFPSLWSQENSRLLKEKTTLSQSFLFQLGMQIHPEYSLEDPALGFWMQRTRSSSAFVAASGCQSSLGAYSSGDVGVIAYGPCSGDISDCYYFGCCGIAKEFVCQKSHQTTEISFLTSTGKPHPRNTGFSYLRDSYVHLPIRCKITISDKQYRVHAALAEATSAMTFSIFCKGKNCQVVDGPRLRSCSLDSYKGPGNDIMILGENDAINIVSASPYMEIFALQGKEKFWNADFLINIPYKEEGVMLIFEKKVTSEKGRFFTKMN

SEQ ID NO: 418 - protein, 105 aa, Chlamydia pneumoniae
  CPn0416
EALSNMATMTKKKLISTISQDHKIHPNHVRTVIQNFLDKMTDALVKGDRLEFRDFGVLQVVERKPKVGRNPKNAAVPIHIPARRAVKFTPGKRMKRLIETPNKHS

SEQ ID NO: 419 - protein, 268 aa, Chlamydia pneumoniae
  CPn0417
REKGMKLTKYLNTKQLRSMISRLFVRYSLPMSKQLSFFALCVLGSHPIFAQTPNPPQRVRRSEVIFIDPGHGGKDQGTASKELHYEEKSLTLSLALTVQSYLKRMGYKPQLTRSSDVYVDLGKRVALSNRGQGDVFISIHCNHSSNAAAFGTEVYFYNGKVGSPTRNRMSEVLGKNILAAMEKNGILKSRGLKTANFVVIRDTSMPAVLVETGFLSNSRERAALQDARYRMHVAKGIAEGVHNFLSGPSFQKPKQNIAKIRKPQIQAN

SEQ ID NO: 420 - protein, 483 aa, Chlamydia pneumoniae
  CPn0418
MDLKELLHGVQAKIYGKVRPLEVRNLTRDSRCVSVGDIFIAHKGQRYDGNDFAVDALANGAIAIASSLYNPFLSVVQIITPNLEELEAELSAKYYEYPSSKLHTIGVTGTNGKTTVTCLIKALLDSYQKPSGLLGTIEHILGEGVIKDGFTTPTPALLQKYLATMVRQNRDAVVMEVSSIGLASGRVAYTNFDTAVLTNITLDHLDFHGTFETYVAAKAKLFSLVPPSGMVVINTDSPYASQCIESAKAPVITYGIESAADYRATDIQLSSSGTKYTLVYGDQKIACSSSFIGKYNVYNLLAAISTVHASLRCDLEDLLEKIGLCQPPPGRLDPVLMGPCPVYIDYAHTPDALDNVLTGLHELLPEGGRLIVVFGCGGDRDRSKRKLMAQVVERYGFAVVTSDNPRSEPPEDIVNEICDGFYSKNYFIEIDRKQAITYALSIASDRDIVLIAGKGHEAYQIFKHQTVAFDDKQTVCEVLASYV

SEQ ID NO: 421 - protein, 674 aa, Chlamydia pneumoniae
  CPn0419
QLFPNTNIWNIPQKKVSVFYPMSYRKRSTLIVLGVFALYALLVLRYYKIQICEGDHWAAEALGQHEFCVRDPFRRGTFFANTTVRKGDKDLQQPFAVDITKFHLCADPLAIPECHRDEIIQGILQFIEGQTYDDLSLKLDKKSRYCKLYPLLDVSVHDRLSLWWKGYATKHRLPTNALFFITDYQRSYPFGKLLGQVLHTLREIKDEKTGKAFPTGGMEAYFNHILEGDVGERKLLRSPLNRLDTNRVIKLPKDGSDIYLTINPVIQTIAEEELERGVLEAKAQGGRLILMNSQTGEILALAQYPFFDPTNYKEYFNNKERIEHTKVSFVSDVFEPGSIMKPLTVAIALQANEEASLKSQKKIFDPEEPIDVTRTLFPGRKGSPLKDISRNSQLNMYMAIQKSSNVYVAQLADRIIQSLGVAWYQQKLLALGFGRKTGIELPSEASGLVPSPHRFHINGSLEWSLSTPYSLAMGYNILATGIQMVQAYAILANGGYAVRPTLVKKIVSASGEEYHLPTKEKTRLFSEEITREVVRAMRFTTLPGGSGFRASPKHHSSAGKTGTTEKMIHGKYDKRRHIASFIGFTPVESSEGNFPPLVMLVSIDDPEYGLRADGTKNYMGGRCAAPIFSRVADRTLLYLGILPDKKLRNCDEEAAALKRLYEEWNRSPKQGGTR

SEQ ID NO: 422 - protein, 99 aa, Chlamydia pneumoniae
  CPn0420
KSFPMNKSRFLRLCCCLCFCGSLFYFYINKQNSLTKLRLEIPCLSVRLRQLEQQNISLRFLIDKIERPDHLMEIAALPEYQYLEYPSEESISLLSYELP

SEQ ID NO: 423 - protein, 300 aa, Chlamydia pneumoniae
  CPn0421
EILMSERAHIPVLVEECLALFAQRPPQTFRDVTLGAGGHAYAFLEAYPSLTCYDGSDRDLQALAIAEKRLETFQDRVSFSHASFEDLANQPTPRLYDGVLADLGVSSMQLDTLSRGFSFQGEKEELDMRMDQTQELSASDVLNSLKEEELGRIFREYGEEPQWKSAAKAVVHFRKHKKILSIQDVKEALLGVFPHYRFHRKIHPLTLIFQALRVYVNGEDRQLKSLLTSAISWLAPQGRLVIISFCSSEDRPVKWFFKEAEASGLGKVITKKVIQPTYQEVRRNPRSRSAKLRCFEKASQ

SEQ ID NO: 424 - protein, 184 aa, Chlamydia pneumoniae
  CPn0422
GLAMVEIFNYSTSIYEQHASNNRIVSDFRKEIQMEGISIRDVAKHAQILDMNPKPSALTSLLQTNQKSHWACFSPPNNFYKQRFSTPYLAPSLGSPDQQDEDIEKISSFLKVLTRGKFSYRSQITPFLSYKDKEEEEDEDPEEDDDDPRVQQGKVLLKALDLGVKSTNVMIDYVISRIFQFVQG

SEQ ID NO: 425 - protein, 143 aa, Chlamydia pneumoniae
  CPn0423
CMLDNEWKAILGWGDDELEELRISGYSFLRQGHYSKAILFFEALVILDPLSIYDHQTLGGLYLQIGENSQALAVLDQALRMQGDHLPTLLNKTKALFCLGRIEEATAIATYLSSCPIPAIANDAEALLMSYSKATKKNAALVR

SEQ ID NO: 426 - protein, 479 aa, Chlamydia pneumoniae
  CPn0424
SRCNEIFSPSLMGWVDCIWWESFINFESGMLTCNECTTWEQFLNYVKTRCSKTAFENWISPIQVLEETQEKIRLEVPNIFVQNYLLDNYKRDLCSFVPLDVHGEPALEFVVAEHKKPSAPVASQKESNEGISEVFEETKDFELKLNLSYRFDNFIEGPSNQFVKSAAVGIAGKPGRSYNPLFIHGGVGLGKTHLLHAVGHYVREHHKNLRIHCITTEAFINDLVYHLKSKSVDKMKNFYRSLDLLLVDDIQFLQNRQNFEEEFCNTFETLINLSKQIVITSDKPPSQLKLSERIIARMEWGLVAHVGIPDLETRVAILQHKAEQKGLLIPNEMAFYIADHIYGNVRQLEGAINKLTAYCRLFGKSLTETTVRETLKELFRSPTKQKISVETILKSVATVFQVKLNDLKGNSRSKDLVLARQIAMYLAKTLITDSLVAIGAAFGKTHSTVLYACKTIEHKLQNDETLKRQVNLCKNHIVG

SEQ ID NO: 427 - protein, 200 aa, Chlamydia pneumoniae
  CPn0425
FRGCPMFRRTGKGPFEDVQTLYEEETSSPSSYSPYSRSERPETPPSLFDNPKASEARPLNHNLTEESSLPQWSSTPRTESLLPLEEPETTLGEGVTFKGELAFERLLRIDGTFEGILVSKGKIIIGPKGVVKADIQLQEAIIEGVVEGNITVSGKVELRGGAIIKGDIQANTLCVDEGVRILGYLAIAGITDHSERERDL

SEQ ID NO: 428 - protein, 192 aa, Chlamydia pneumoniae
  CPn0426
MVLFSLLFPKLCYGCQAPGAYFCSNCLEKLLVEDREGRCLHCFRYLGSSETRLCSQCSPSSQLQAFSLYLPSQTALSVYARACEGKRPALQFFSKSIAFELASLDETPSCIAYITSTISRKIVVEVAKLEKLLRIPLWPWLPKKRQIEKLPKGEGICFLSAYPLSQKWMQTIVGGSASPLVSISLFLSQNDQ

SEQ ID NO: 429 - protein, 521 aa, Chlamydia pneumoniae
  CPn0427
AVCYVFERVEASTFLSITMLKKFINSLWKLCQQDKYQRFTPIVDAIDTFCYEPIETPSKPPFIRDSVDVKRWMMLVVIALFPATFVAIWNSGLQSIVYSSGNPVLMEQFLHISGFGSYLSFVYKEIHIVPILWEGLKIFIPLLTISYVVGGTCEVLFAVVRGHKIAEGLLVTGILYPLTLPPTIPYWMAALGIAFGIVVSKELFGGTGMNILNPALSGRAFLFFTFPAKMSGDVWVGSNPGVIKDSLMKMNSSTGKVLIDGFSQSTCLQTLNSTPPSVKRLHVDAIAANMLHIPHVPTQDVIHSQFSLWTETHPGWVLDNLTLTQLQTFVTAPVAEGGLGLLPTQFDSAYAITDVIYGIGKFSAGNLFWGNIIGSLGETSTFACLLGAIFLIVTGIASWRTMAAFGIGAFLTGWLFKFISVLIVGQNGAWAPARFFIPAYRQLFLGGLAFGLVFMATDPVSSPTMKLGKWIYGFFIGFMTIVIRLINPAYPEGVMLAILLGNVFAPLIDYFAVRKYRKRGV

SEQ ID NO: 430 - protein, 321 aa, Chlamydia pneumoniae
  CPn0428
NMSKGSSKHTVRINQTWYIVSFILGLSLFAGVLLSTIYYVLSPIQEQAATFDRNKQMLLAAHILDFKGRFQIQEKKEWVPATFDKKTQLLEVATKKVSEVSYPELELYAERFVRPLLTDAQGKVFSFEEKNLNPIEFFEKYQESPPCQQSPLPFYVILENTSRTENMSGADVAKDLSTVQALIFPISGFGLWGPIHGYLGVKNDGDTVLGTAWYQQGETPGLGANITNPEWQEQFYGKKIFLQDSSGTTNFATTDLGLEVVKGSVRTTLGDSPKALSAIDGISGATLTCNGVTEAYVQSLACYRQLLINFSNLTHEKKTGE

SEQ ID NO: 431 - protein, 218 aa, Chlamydia pneumoniae
  CPn0429
KENRRMTSKKSYKSYFFDPLWSNNQILIAILGICSALAVTTTVQTAITMGIAVSIVTGCSSFFVSLLRKFTPDSVRMITQLIIISLFVIVIDQFLKAFFFDISKTLSVFVGLIITNCIVMGRSESLARHVTPIPAFLDGFASGLGYGWVLLVIGVIRELFGFGTLMGFRIIPQFVYASETHPDGYQNLSLMVLAPSAFFLLGIMIWLVNIRDSKKRKR

SEQ ID NO: 432 - protein, 257 aa, Chlamydia pneumoniae
  CPn0430
FMWLGAYTWLNVFGILLQAAFIQNILLANFLGMCSYLACSTRVSTANGLGMSVALVLTVTGSINWFVHAFITGPKALTWISPSLASVNLGFLELIIFIVVIAAFTQILELLLEKVSRNLYLSLGIFLPLIAVNCAILGGVLFGITRSYPFIPMMIFSLGAGCGWWLAIVILATIKEKLAYSDIPKNLQGMGISFITTGLIAMAFMSLTGIDISKPSAKIQRAPLETEVVENTTNPLKESSSKHQPSISKARTQRRSL

SEQ ID NO: 433 - protein, 113 aa, Chlamydia pneumoniae
  CPn0431
KIMTTLPKYVPRSRQNPDTLTFLKRYSSVLLHSENSLSYRIFAKVLAILLTSLAVAFAVTLFSCEGSQLRLCALYIGIALAICVLLTIVVYCIASKIATACKKPPSISRIEIV

SEQ ID NO: 434 - protein, 108 aa, Chlamydia pneumoniae
  CPn0432
KIHQNYSMDPASPVAPHVLQDHVQLSSEELSALSSGVSRVKKLTIAIMVLSLIAISLVACGLFLTGSAPLQLSIWIAASCITLSMLVCACWRYKISNALEKTKVAHES

SEQ ID NO: 435 - protein, 133 aa, Chlamydia pneumoniae
  CPn0433
RTFRILYGTLYRTGSRKVMWYSDYHVWILPVHERVVRLGLTEKMQKNLGAILHVDLPSVGSLCKEGEVLVILESSKSAIEVLSPVSGEVIDINLDLVDNPQKINEAPEGEGWLAVVRLDQDWDPSNLSLMDEE

SEQ ID NO: 436 - protein, 732 aa, Chlamydia pneumoniae
  CPn0434
RPWVRIYQQDLFCRLCRDPAWFFSLLSFTLRFYCLGRGWTLLSFFYKHQKKFIGIVIAVVCVSGIGVGWGRFSRKGSAESTSRRTVFTTASGKRYVEKDFMAMKKFFAHEAYPFTGNPRAWNFINEGLLTDYFLTTRVGEKLFLKVYHPGEKIFSKEKAYQPYRRFDAPFISSEEVWKSSAPQLLEILKVFQQIENPISKEGFLARAKLFLEERRFPHYVLRQMLEYRRQMFALPPDEALSRGKDLRLFGYQTIQDWFGDAYLSAAVELLIRFIDEQKKVLPRPSKQEARDDFYDKAKHAYTKISKNKEFSLGFEEFVNSYFQFLEISESEFFNMYRDILLCKRALLLLQGGVSFDFQPLTTFFVQGKDSIQVEFFRLPKEYSFKTKQELKAFEVYLKLVSLPKSDSLDVPNEILPIATIKAKEPRLVGRRFSIDYKRVALQDLAATVPMVEVLHWQQNSEHFQEILQQFPDVETCQSYKDFQHLKPALRDKISLFTRKEILRARPERILQSLQQVPKQSQEVLLSAGKNSALPGISDGQQLAKVLLENEVLDLYSQDAETYYTIIVNSSFEKEEVLPYREVLKRDLASQLLTSHGHLVDMERLESALRTRYPGEEGASLWQRRLWKVVENHRLGRHLEGSFSWSLDRSLKTFSRGDKELPQEFDRIFSMKVGDYSSVFMSPNEGPCYYQCLSHLLYDRPASVDKLFLAKSQLDEELLGSYMERFIEQGVVR

SEQ ID NO: 437 - protein, 478 aa, Chlamydia pneumoniae
  CPn0435
GVMMSRLRFRLAALGIFFILLVPNSVSAKTIVASDKEKVGVLVYDNSVEAFQQILDCIDHANFYVELCPCMTGGRTLKEMVDHLEARMDLVPELCSYIIIQPTFTDAEDQKLLKALKERHPNRFFYVFTGCPPSTSILAPNVIEMHIKLSIIDGKYCILGGTNFEEFMCTPGDEVPEKVDNPRLFVSGVRRPLAFRDQDIMLRSTAFGLQLREEYHKQFAMWDYYAHHMWFIDNPEQFAGACPPLTLEQAEETVFPGFDKHEDLVLVDSSKIRIVLGGPHDKQPNPVTQEYLKLIQGARSSVKLAHMYFIPKDELLNALVDVSHNHGVHLSLITNGCHELSPAITGPYAWGNRINYFALLYGKRYPLWKKWFCEKLKPYERVSIYEFAIWETQLHKKCMIIDDEIFVIGSYNFGKKSDAFDYESIVVIESPEVAAKANKVFNKDIGLSIPVSHGDIFSWYFHSVHHTLGHLQLTYMPA

SEQ ID NO: 438 - protein, 244 aa, Chlamydia pneumoniae
  CPn0436
FYVCYMKVRIVDSGKSSAASHMAKDRDLLESLQDGELILHLYEWENPCSLTYGHFMRPEKFLLSNYADLGLDAAVRPTGGGFVFHKGDYAFSVLMSATHPSYSSSVLENYHTVNSFVAKVLEKVFRIQGMLAPEDENSSSRDSGNFCMAKTSKYDVLFGDKKIGGAAQRKVQQGFLHQGSLFLSGSSSEFYQRFLKPEVLEEIIEQIQIHAFFPLGLEAADEVLQEARQQVKEAFIKLFCGEGL

SEQ ID NO: 439 - protein, 847 aa, Chlamydia pneumoniae
  CPn0437
VFMFEKFTNRAKQVIKLAKKEAQRLNHNYLGTEHILLGLLKLGQGVAVNVLRNLGIDFDTARQEVERLIGYGPEIQVYGDPALTGRVKKSFESANEEASLLEHNYVGTEHLLLGILHQSDSVALQVLENLHIDPREVRKEILRELETFNLQLPPSSSSSSSSSRSNPSSSKSPLGHSLGSDKNEKLSALKAYGYDLTEMVRESKLDPVIGRSSEVERLILILCRRRKNNPVLIGEAGVGKTAIVEGLAQKIILNEVPDALRKKRLITLDLALMIAGTKYRGQFEERIKAVMDEVRKHGNILLFIDELHTIVGAGAAEGAIDASNILKPALARGEIQCIGATTIDEYRKHIEKDAALERRFQKIVVHPPSVDETIEILRGLKKKYEEHHNVFITEEALKAAATLSDQYVHGRFLPDKAIDLLDEAGARVRVNTMGQPTDLMKLEAEIENTKLAKEQAIGTQEYEKAAGLRDEEKKLRERLQSMKQEWENHKEEHQVPVDEEAVAQVVSLQTGIPSARLTEAESEKLLKLEDTLRRKVIGQNDAVTSICRAIRRSRTGIKDPNRPTGSFLFLGPTGVGKSLLAQQIAIEMFGGEDALIQVDMSEYMEKFAATKMMGSPPGYVGHEEGGHLTEQVRRRPYCVVLFDEIEKAHPDIMDLMLQILEQGRLTDSFGRKVDFRHAIIIMTSNLGADLIRKSGEIGFGLKSHMDYKVIQEKIEHAMKKHLKPEFINRLDESVIFRPLEKESLSEIIHLEINKLDSRLKNYQMALNIPDSVISFLVTKGHSPEMGARPLRRVIEQYLEDPLAELLLKESCRQEARKLRATLVENRVAFEREEEEQEAALPSPHLES

SEQ ID NO: 440 - protein, 374 aa, Chlamydia pneumoniae
  CPn0438
NLTLPMRRQVREIMQQTVIVAMSGGVDSSVVAYLFKKFTNYKVIGLFMKNWEEDSEGGLCSSTKDYEDVERVCLQLDIPYYTVSFAKEYRERVFARFLKEYSLGYTPNPDILCNREIKFDLLQKKVQELGGDYLATGHYCRLNTELQETQLLRGCDPQKDQSYFLSGTPKSALHNVLFPLGEMNKTEVRAIAAQAALPTAEKKDSTGICFIGKRPFKEFLEKFLPNKTGNVIDWDTKEIVGQHQGAHYYTIGQRRGLDLGGSEKPCYVVGKNIEENSIYIVRGEDHPQLYLRELTARELNWFTPPKSGCHCSAKVRYRSPDEACTIDYSSGDEVKVRFSQPVKAVTPGQTIAFYQGDTCLGSGVIDVPMIPSEG

SEQ ID NO: 441 - protein, 185 aa, Chlamydia pneumoniae
  CPn0439
IISSNNRVLFVSSTLNGVFPSSLPEESADLFITNKEIVALGEKGNVFLTHSIPMHIAAITILVIVALAGIAIICLGCYSQSILLIAVGIVLTILTLLCLQALVGFIKFIRQLPQQLHTTVQFIREKIRPESSLQLVTNAQRKTTQDTLKLYEELCDLSQKEFKLQSTLYQKRFELSHKNEKTNQN

SEQ ID NO: 442 - protein, 220 aa, Chlamydia pneumoniae
  CPn0440
LATIRGNNMATSVAPSPVPESSPLSHATEVLNLPNAYITQPHPIPAAPWETFRSKLSTKHTLCFALTLLLTLGGTISAGYAGYTGNWIICGIGLGIIVLTLILALLLAIPLKNKQTGTKLIDEISQDISSIGSGFVQRYGLMFSTIKSVHLPELTTQNQEKTRILNEIEAKKESIQNLELKITECQNKLAQKQPKRKSSQKSFMRSIKHLSKNPVILFDC

SEQ ID NO: 443 - protein, 323 aa, Chlamydia pneumoniae
  CPn0441
RWRILQNMFKLLFHIAAFAGHVLSTPIFIVQDACGIDEEACKNPPPRPFSAQVQYLKVNDAKFKKLPHQTIGYRQYDGTFLCTLPITEHSGLLFSTGYIGADIQWKSSLPISETDPNGLGWATFQDTSFYNYVLLSLGAYTLSLKNWQWSIILSGLVDPKNIEMGYGLYQGVLSGKYQATEKLSAIFGVINETGLHQEKAWPLVGVSYKATDQLTLNCIYPVNFSIDYRSTSVCNLGLAYRLTRFRKKLHKNHLISSRGIFEYQGREIEANVKLTPWPGSFIKGFYGWSIGNDISIADDHNNNKTSHTFKTSAFFGGSAVMNF

SEQ ID NO: 444 - protein, 179 aa, Chlamydia pneumoniae
  CPn0442
NILFQTDMGFKNICKQGSQLYLNGIFPERILARKLKNCAKSYPRTALTIEVLVSSVLGALKVILIPCASTYAALTLPLRALFNAIKTKSCQHLASYAMAWLLHILTIAVIIGLVFSLVFIPPPVVFISLGLLMSVTTSVTLFQVHKNLFPPYEPPPSRPHTPPPFADEYVPLISESYFD

SEQ ID NO: 445 - protein, 420 aa, Chlamydia pneumoniae
  CPn0443
VDSMSQPPINPLGQPQVPAAASPSGQPSVVKRLKTSSTGLFKRFITIPDKYPKMRYVYDTGIIALAAIAILSILLTASGNSLMLYALAPALALGALGVTLLISDILDSPKAKKIGEAITAIVVPIIVLAIAAGLIAGAFVASSGTMLVFANPMFVMGLITVGLYFMSLNKLTLDYFRREHLLRMEKKTQETAEPILVTPSADDAKKIAVEKKKDLSASARMEEHEASQRQDARHRRIGREAQGSFFYSSRNPEHRRSFGSLSRFKTKPSDAASTRPASISPPFKDDFQPYHFKDLRSSSFGSGASSAFTPIMPASSRSPNFSTGTVLHPEPVYPKGGKEPSIPRVSSSSRRSPRDRQDKQQQQQNQDEEQKQQSKKKSGKSNQSLKTPPPDGKSTANLSPSNPFSDGYDEREKRKHRKNK

SEQ ID NO: 446 - protein, 1414 aa, Chlamydia pneumoniae
  CPn0444
KAFPQRHMKYSLPWLLTSSALVFSLHPLMAANTDLSSSDNYENGSSGSAAFTAKETSDASGTTYTLTSDVSITNVSAITPADKSCFTNTGGALSFVGADHSLVLQTIALTHDGAAINNTNTALSFSGFSSLLIDSAPATGTSGGKGAICVTNTEGGTATFTDNASVTLQKNTSEKDGAAVSAYSIDLAKTTTAALLDQNTSTKNGGALCSTANTTVQGNSGTVTFSSNTATDKGGGIYSKEKDSTLDANTGVVTFKSNTAKTGGAWSSDDNLALTGNTQVLFQENKTTGSAAQANNPEGCGGAICCYLATATDKTGLAISQNQEMSFTSNTTTANGGAIYATKCTLDGNTTLTFDQNTATAGCGGAIYTETEDFSLKGSTGTVTFSTNTAKTGGALYSKGNSSLTGNTNLLFSGNKATGPSNSSANQEGCGGAILAFIDSGSVSDKTGLSIANNQEVSLTSNAATVSGGAIYATKCTLTGNGSLTFDGNTAGTSGGAIYTETEDFTLTGSTGTVTFSTNTAKTGGALYSKGNNSLSGNTNLLFSGNKATGPSNSSANQEGCGGAILSFLESASVSTKKGLWIEDNENVSLSGNTATVSGGAIYATKCALHGNTTLTFDGNTAETAGGAIYTETEDFTLTGSTGTVTFSTNTAKTAGALHTKGNTSFTKNKALVFSGNSATATATTTTDQEGCGGAILCNISESDIATKSLTLTENESLSFINNTAKRSGGGIYAPKCVISGSESINFDGNTAETSGGAIYSKNLSITANGPVSFTNNSGGKGGAIYIADSGELSLEAIDGDITFSGNRATEGTSTPNSIHLGAGAKITKLAAAPGHTIYFYDPITMEAPASGGTIEELVINPVVKAIVPPPQPKNGPIASVPVVPVAPANPNTGTIVFSSGKLPSQDASIPANTTTILNQKINLAGGNVVLKEGATLQVYSFTQQPDSTVFMDAGTTLETTTTNNTDGSIDLKNLSVNLDALDGKRMITIAVNSTSGGLKISGDLKFHNNEGSFYDNPGLKANLNLPFLDLSSTSGTVNLDDFNPIPSSMAAPDYGYQGSWTLVPKVGAGGKVTLVAEWQALGYTPKPELRATLVPNSLWNAYVNIHSIQQEIATAMSDAPSHPGIWIGGIGNAFHQDKQKENAGFRLISRGYIVGGSMTTPQEYTFAVAFSQLFGKSKDYVVSDIKSQVYAGSLCAQSSYVIPLHSSLRRHVLSKVLPELPGETPLVLHGQVSYGRNHHNMTTKLANNTQGKSDWDSHSFAVEVGGSLPVDLNYRYLTSYSPYVKLQVVSVNQKGFQEVAADPRIFDASHLVNVSIPMGLTFKHESAKPPSALLLTLGYAVDAYRDHPHCLTSLTNGTSWSTFATNLSRQAFFAEASGHLKLLHGLDCFASGSCELRSSSRSYNANCGTRYSF

SEQ ID NO: 447 - protein, 947 aa, Chlamydia pneumoniae
  CPn0445
FNFLVSKKCLQMKSSVSWLFFSSIPLFSSLSIVAAEVTLDSSNNSYDGSNGTTFTVFSTTDAAAGTTYSLLSDVSFQNAGALGIPLASGCFLEAGGDLTFQGNQHALKFAFINAGSSAGTVASTSAADKNLLFNDFSRLSIISCPSLLLSPTGQCALKSVGNLSLTGNSQIIFTQNFSSDNGGVINTKNFLLSGTSQFASFSRNQAFTGKQGGVVYATGTITIENSPGIVSFSQNLAKGSGGALYSTDNCSITDNFQVIFDGNSAWEAAQAQGGAICCTTTDKTVTLTGNKNLSFTNNTALTYGGAISGLKVSISAGGPTLFQSNISGSSAGQGGGGAINIASAGELALSATSGDITFNNNQVTNGSTSTRNAINIIDTAKVTSIRAATGQSIYFYDPITNPGTAASTDTLNLNLADANSEIEYGGAIVFSGEKLSPTEKAIAANVTSTIRQPAVLARGDLVLRDGVTVTFKDLTQSPGSRILMDGGTTLSAKEANLSLNGLAVNLSSLDGTNKAALKTEAADKNISLSGTIALIDTEGSFYENHNLKSASTYPLLELTTAGANGTITLGALSTLTLQEPETHYGYQGNWQLSWANATSSKIGSINWTRTGYIPSPERKSNLPLNSLWGNFIDIRSINQLIETKSSGEPFERELWLSGIANFFYRDSMPTRHGFRHISGGYALGITATTPAEDQLTFAFCQLFARDRNHITGKNHGDTYGASLYFHHTEGLFDIANFLWGKATRAPWVLSEISQIIPLSFDAKFSYLHTDNHMKTYYTDNSIIKGSWRNDAFCADLGASLPFVISVPYLLKEVEPFVKVQYIYAHQQDFYERHAEGRAFNKSELINVEIPIGVTFERDSKSEKGTYDLTLMYILDAYRRNPKCQTSLIASDANWMAYGTNLARQGFSVRAANHFQVNPHMEIFGQFAFEVRSSSRNYNTNLGSKFCF

SEQ ID NO: 448 - protein, 938 aa, Chlamydia pneumoniae
  CPn0446
LIEPKHLSMKIPLHKLLISSTLVTPILLSIATYGADASLSPTDSFDGAGGSTFTPKSTADANGTNYVLSGNVYINDAGKGTALTGCCFTETTGDLTFTGKGYSFSFNTVDAGSNAGAAASTTADKALTFTGFSNLSFIAAPGTTVASGKSTLSSAGALNLTDNGTILFSQNVSNEANNNGGAITTKTLSISGNTSSITFTSNSAKKLGGAIYSSAAASISGNTGQLVFMNNKGETGGGALGFEASSSITQNSSLFFSGNTATDAAGKGGAIYCEKTGETPTLTISGNKSLTFAENSSVTQGGAICAHGLDLSAAGPTLFSNNRCGNTAAGKGGAIAIADSGSLSLSANQGDITFLGNTLTSTSAPTSTRNAIYLGSSAKITNLRAAQGQSIYFYDPIASNTTGASDVLTINQPDSNSPLDYSGTIVFSGEKLSADEAKAADNFTSILKQPLALASGTLALKGNVELDVNGFTQTEGSTLLMQPGTKLKADTEAISLTKLVVDLSALEGNKSVSIETAGANKTITLTSPLVFQDSSGNFYESHTINQAFTQPLVVFTAATAASDIYIDALLTSPVQTPEPHYGYQGHWEATWADTSTAKSGTMTWVTTGYNPNPERRASVVPDSLWASFTDIRTLQQIMTSQANSIYQQRGLWASGTANFFHKDKSGTNQAFRHKSYGYIVGGSAEDFSENIFSVAFCQLFGKDKDLFIVENTSHNYLASLYLQHRAFLGGLPMPSFGSITDMLKDIPLILNAQLSYSYTKNDMDTRYTSYPEAQGSWTNNSGALELGGSLALYLPKEAPFFQGYFPFLKFQAVYSRQQNFKESGAEARAFDDGDLVNCSIPVGIRLEKISEDEKNNFEISLAYIGDVYRKNPRSRTSLMVSGASWTSLCKNLARQAFLASAGSHLTLSPHVELSGEAAYELRGSAHIYNVDCGLRYSF

SEQ ID NO: 449 - protein, 937 aa, Chlamydia pneumoniae
  CPn0447
FVKPPIALYMKSSLHWFLISSSLALPLSLNFSAFAAVVEINLGPTNSFSGPGTYTPPAQTTNADGTIYNLTGDVSITNAGSPTALTASCFKETTGNLSFQGHGYQFLLQNIDAGANCTFTNTAANKLLSFSGFSYLSLIQTTNATTGTGAIKSTGACSIQSNYSCYFGQNFSNDNGGALQGSSISLSLNPNLTFAKNKATQKGGALYSTGGITINNTLNSASFSENTAANNGGAIYTEASSFISSNKAISFINNSVTATSATGGAIYCSSTSAPKPVLTLSDNGELNFIGNTAITSGGAIYTDNLVLSSGGPTLFKNNSAIDTAAPLGGAIAIADSGSLSLSALGGDITFEGNTVVKGASSSQTTTRNSINIGNTNAKIVQLRASQGNTIYFYDPITTSITAALSDALNLNGPDLAGNPAYQGTIVFSGEKLSEAEAAEADNLKSTIQQPLTLAGGQLSLKSGVTLVAKSFSQSPGSTLLMDAGTTLETADGITINNLVLNVDSLKETKKATLKATQASQTVTLSGSLSLVDPSGNVYEDVSWNNPQVFSCLTLTADDPANIHITDLAADPLEKNPIHWGYQGNWALSWQEDTATKSKAATLTWTKTGYNPNPERRGTLVANTLWGSFVDVRSIQQLVATKVRQSQETRGIWCEGISNFFHKDSTKINKGFRHISAGYVVGATTTLASDNLITAAFCQLFGKDRDHFINKNRASAYAASLHLQHLATLSSPSLLRYLPGSESEQPVLFDAQISYIYSKNTMKTYYTQAPKGESSWYNDGCALELASSLPHTALSHEGLFHAYFPFIKVEASYIHQDSFKERNTTLVRSFDSGDLINVSVPIGITFERFSRNERASYEATVIYVADVYRKNPDCTTALLINNTSWKTTGTNLSRQAGIGRAGIFYAFSPNLEVTSNLSMEIRGSSRSYNADLGGKFQF

SEQ ID NO: 450 - protein, 393 aa, Chlamydia pneumoniae
  CPn0448
FIQPSRREIHEWKCILLGSSLRMEMMSPFQQPEQCHFDVVGSFLRPESLTRARSDFEEGRIVYEQMRVVEDAAIRNLIKKQTEAGLIFFTDGEFRRYSWDFDFMWGFHGVDRRRDSNDPEIGVYLKDKISVSKHPFIEHFEFVKTFEKGNAKAKQTIPSPSQFFHEMIFAPNLKNTRKFYPTNQELIDDIVFYYRQVIQDLYAAGCRNLQLDDCAWCRLLDIRAPSWYGVDSHDRLQEILEQFLWIHNLVMKDRPEDLFVSLHVCRGDYQAEFFSRRAYDSIEEPLFAKTDVDSYHYYWALDDKYSGGAEPLAYVSGEKHVCLGLISSNHSCIEDRDAVVSRIYEAASYIPLERLSLSPQCGFASCEGDHRMTEEEQWKKIAFVKEIAKEIWG

SEQ ID NO: 451 - protein, 634 aa, Chlamydia pneumoniae
  CPn0449
EAYTGFRGGGGISFSNNIVQGTTAGNGGAISILAAGECSLSAEAGDITFNGNAIVATTPQTTKRNSIDIGSTAKITNLRAISGHSIFFYDPITANTAADSTDTLNLNKADAGNSTDYSGSIVFSGEKLSEDEAKVADNLTSTLKQPVTLTAGNLVLKRGVTLDTKGFTQTAGSSVIMDAGTTLKASTEEVTLTGLSIPVDSLGEGKKVVIAASAASKNVALSGPILLLDNQGNAYENHDLGKTQDFSFVQLSALGTATTTDVPAVPTVATPTHYGYQGTWGMTWVDDTASTPKTKTATLAWTNTGYLPNPERQGPLVPNSLWGSFSDIQAIQGVIERSALTLCSDRGFWAAGVANFLDKDKKGEKRKYRHKSGGYAIGGAAQTCSENLISFAFCQLFGSDKDFLVAKNHTDTYAGAFYIQHITECSGFIGCLLDKLPGSWSHKPLVLEGQLAYSHVSNDLKTKYTAYPEVKGSWGNNAFNMMLGASSHSYPEYLHCFDTYAPYIKLNLTYIRQDSFSEKGTEGRSFDDSNLFNLSLPIGVKFEKFSDCNDFSYDLTLSYVPDLIRNDPKCTTALVISGASWETYANNLARQALQVRAGSHYAFSPMFEVLGQFVFEVRGSSRIYNVDLGGKFQF

SEQ ID NO: 452 - protein, 314 aa, Chlamydia pneumoniae
  CPn0450
SGFMKSQFSWLVLSSTLACFTSCSTVFAATAENIGPSDSFDGSTNTGTYTPKNTTTGIDYTLTGDITLQNLGDSAALTKGCFSDTTESLSFAGKGYSLSFLNIKSSAEGAALSVTTDKNLSLTGFSSLTFLAAPSSVITTPSGKGAVKCGGDLTFDNNGTILFKQDYCEENGGAISTKNLSLKNSTGSISFEGNKSSATGKKGGAICATGTVDITNNTAPTLFSNNIAEAAGGAINSTGNCTITGNTSLVFSENSVTATAGNGGALSGDADVTISGNQSVTFSGNQAVANGGAIYAKKLTLASGGGGVSPFLTI

SEQ ID NO: 453 - protein, 967 aa, Chlamydia pneumoniae
  CPn0451
KTQRVKIKILDSCFVIFNLIYLFCFYIDANSSLKNKSITMKTSIPWVLVSSVLAFSCHLQSLANEELLSPDDSFNGNIDSGTFTPKTSATTYSLTGDVFFYEPGKGTPLSDSCFKQTTDNLTFLGNGHSLTFGFIDAGTHAGAAASTTANKNLTFSGFSLLSFDSSPSTTVTTGQGTLSSAGGVNLENIRKLVVAGNFSTADGGAIKGASFLLTGTSGDALFSNNSSSTKGGAIATTAGARIANNTGYVRFLSNIASTSGGAIDDEGTSILSNNKFLYFEGNAAKTTGGAICNTKASGSPELIISNNKTLIFASNVAETSGGAIHAKKLALSSGGFTEFLRNNVSSATPKGGAISIDASGELSLSAETGNITFVRNTLTTTGSTDTPKRNAINIGSNGKFTELRAAKNHTIFFYDPITSEGTSSDVLKINNGSAGALNPYQGTILFSGETLTADELKVADNLKSSFTQPVSLSGGKLLLQKGVTLESTSFSQEAGSLLGMDSGTTLSTTAGSITITNLGINVDSLGLKQPVSLTAKGASNKVIVSGKLNLIDIEGNIYESHMFSHDQLFSLLKITVDADVDTNVDISSLIPVPAEDPNSEYGFQGQWNVNWTTDTATNTKEATATWTKTGFVPSPERKSALVCNTLWGVFTDIRSLQQLVEIGATGMEHKQGFWVSSMTNFLHKTGDENRKGFRHTSGGYVIGGSAHTPKDDLFTFAFCHLFARDKDCFIAHNNSRTYGGTLFFKHSHTLQPQNYLRLGRAKFSESAIEKFPREIPLALDVQVSFSHSDNRMETHYTSLPESEGSWSNECIAGGIGLDLPFVLSNPHPLFKTFIPQMKVEMVYVSQNSFFESSSDGRGFSIGRLLNLSIPVGAKFVQGDIGDSYTYDLSGFFVSDVYRNNPQSTATLVMSPDSWKIRGGNLSRQAFLLRGSNNYVYNSNCELFGHYAMELRGSSRNYNVDVGTKLRF

SEQ ID NO: 454 - protein, 519 aa, Chlamydia pneumoniae
  CPn0452
FNEETMTILRNFLTCSALFLALPAAAQVVYLHESDGYNGAINNKSLEPKITCYPEGTSYIFLDDVRISNVKHDQEDAGVFINRSGNLFFMGNRCNFTFHNLMTEGFGAAISNRVGDTTLTLSNFSYLAFTSAPLLPQGQGAIYSLGSVMIENSEEVTFCGNYSSWSGAAIYTPYLLGSKASRPSVNLSGNRYLVFRDNVSQGYGGAISTHNLTLTTRGPSCFENNHAYHDVNSNGGAIAIAPGGSISISVKSGDLIFKGNTASQDGNTIHNSIHLQSGAQFKNLRAVSESGVYFYDPISHSESHKITDLVINAPEGKETYEGTISFSGLCLDDHEVCAENLTSTILQDVTLAGGTLSLSDGVTLQLHSFKQEASSTLTMSPGTTLLCSGDARVQNLHILIEDTDNFVPVRIRAEDKDALVSLEKLKVAFEAYWSVYDFPQFKEAFTIPLLELLGPSFDSLLLGETTLERTQVTTENDAVRGFWSLSWEEYPPSLDKDRRITPTKKTVFLTWNPEITSTP

SEQ ID NO: 455 - protein, 999 aa, Chlamydia pneumoniae
  CPn0453
NCVLLYLFFYSLSLICRIIWFHLYVQMKTSIRKFLISTTLAPCFASTAFTVEVIMPSENFDGSSGKIFPYTTLSDPRGTLCIFSGDLYIANLDNAISRTSSSCFSNRAGALQILGKGGVFSFLNIRSSADGAAISSVITQNPELCPLSFSGFSQMIFDNCESLTSDTSASNVIPHASAIYATTPMLFTNNDSILFQYNRSAGFGAAIRGTSITIENTKKSLLFNGNGSISNGGALTGSAAINLINNSAPVIFSTNATGIYGGAIYLTGGSMLTSGNLSGVLFVNNSSRSGGAIYANGNVTFSNNSDLTFQNNTASPQNSLPAPTPPPTPPAVTPLLGYGGAIFCTPPATPPPTGVSLTISGENSVTFLENIASEQGGALYGKKISIDSNKSTIFLGNTAGKGGAIAIPESGELSLSANQGDILFNKNLSITSGTPTRNSIHFGKDAKFATLGATQGYTLYFYDPITSDDLSAASAAATVVVNPKASADGAYSGTIVFSGETLTATEAATPANATSTLNQKLELEGGTLALRNGATLNVHNFTQDEKSVVIMDAGTTLATTNGANNTDGAITLNKLVINLDSLDGTKAAVVNVQSTNGALTISGTLGLVKNSQDCCDNHGMFNKDLQQVPILELKATSNTVTTTDFSLGTNGYQQSPYGYQGTWEFTIDTTTHTVTGNWKKTGYLPHPERLAPLIPNSLWANVIDLRAVSQASAADGEDVPGKQLSITGITNFFHANHTGDARSYRHMGGGYLINTYTRITPDAALSLGFGQLFTKSKDYLVGHGHSNVYFATVYSNITKSLFGSSRFFSGGTSRVTYSRSNEKVKTSYTKLPKGRCSWSNNCWLGELEGNLPITLSSRILNLKQIIPFVKAEVAYATHGGIQENTPEGRIFGHGHLLNVAVPVGVRFGKNSHNRPDFYTIIVAYAPDVYRHNPDCDTTLPINGATWTSIGNNLTRSTLLVQASSHTSVNDVLEIFGHCGCDIRRTSRQYTLDIGSKLRF

SEQ ID NO: 456 - protein, 979 aa, Chlamydia pneumoniae
  CPn0454
GMPLSFKSSSFCLLACLCSASCAFAETRLGGNFVPPITNQGEEILLTSDFVCSNFLGASFSSSFINSSSNLSLLGKGLSLTFTSCQAPTNSNYALLSAAETLTFKNFSSINFTGNQSTGLGGLIYGKDIVFQSIKDLIFTTNRVAYSPASVTTSATPAITTVTTGASALQPTDSLTVENISQSIKFFGNLANFGSAISSSPTAVVKFINNTATMSFSHNFTSSGGGVIYGGSSLLFENNSGCIIFTANSCVNSLKGVTPSSGTYALGSGGAICIPTGTFELKNNQGKCTFSYNGTPNDAGAIYAETCNIVGNQGALLLDSNTAARNGGAICAKVLNIQGRGPIEFSRNRAEKGGAIFIGPSVGDPAKQTSTLTILASEGDIAFQGNMLNTKPGIRNAITVEAGGEIVSLSAQGGSRLVFYDPITHSLPTTSPSNKDITINANGASGSVVFTSKGLSSTELLLPANTTTILLGTVKIASGELKITDNAVVNVLGFATQGSGQLTLGSGGTLGLATPTGAPAAVDFTIGKLAFDPFSFLKRDFVSASVNAGTKNVTLTGALVLDEHDVTDLYDMVSLQSPVAIPIAVFKGATVTKTGFPDGEIATPSHYGYQGKWSYTWSRPLLIPAPDGGFPGGPSPSANTLYAVWNSDTLVRSTYILDPERYGEIVSNSLWISFLGNQAFSDILQDVLLIDHPGLSITAKALGAYVEHTPRQGHEGFSGRYGGYQAALSMNYTDHTTLGLSFGQLYGKTNANPYDSRCSEQMYLLSFFGQFPIVTQKSEALISWKAAYGYSKNHLNTTYLRPDKAPKSQGQWHNNSYYVLISAEHPFLNWCLLTRPLAQAWDLSGFISAEFLGGWQSKFTETGDLQRSFSRGKGYNVSLPIGCSSQWFTPFKKAPSTLTIKLAYKPDIYRVNPHNIVTVVSNQESTSISGANLRRHGLFVQIHDVVDLTEDTQAFLNYTFDGKNGFTNHRVSTGLKSTF

SEQ ID NO: 457 - protein, 302 aa, Chlamydia pneumoniae
  CPn0455
RYFRRVWLRFLLLVSYDEKEKDVVVVCNHSEPNILGLPPEAVSQLIEELSDEGYSYLNVVRCDLSGETTVQQRLLLNADEGRSMTVVISELPEGHPDIRNLQLASERIFVSREKEAADAYASGCKVVAFDDEHLPWVSSHIAYAEEIREKQEQTMQGSLTEEQLGALLCNTVSTEKNLAFALDAVIKQSVWRFRNPDLFAYEREALEASVTDALVSYVSNLDMIPYTSSQGIVIEDSSIVRTSQEHTLIVNCAAFDKLASQIEFLCPSDVLPISGKDPLISDDEDEELNPKVSSAADSKDKT

SEQ ID NO: 458 - protein, 414 aa, Chlamydia pneumoniae
  CPn0456
IPCTFESKRKFLMTHCLHGWFSVVRHHFVQAFNFSRPLYSRITHFALGVIKAIPIVGHLVMGVDWLISHCFERGVSHPGFPSDIAPILKVEKIAGRDHISRIENQLKSLRKTIEVEDLDKVHGQYQENPYADMASSEVLKLDKGVHVSELGKAFSRVRNRITRSYSYAPTPQLDSIAIVGIDLVSPEEQENLVRLANEVIQLYPKSKTTLYLLIDFNKEWVGDISSDKEKQLRSLGLHSEVQCLSVLEPQGAEGEDTKHFDLMVGCYGKDSYLREGKILQQALGTSLGTVPWVNVMHTLPSRYRSRLSLPINTEKDKTELYKEISRTHHQLHTLGMGLGAQDSGLLLDRQRLHAPLSQGSHCHSYLADLTHEELKILLFSAFVDAKNISKKELREVSLNFANDTSVECGCAFYF

SEQ ID NO: 459 - protein, 589 aa, Chlamydia pneumoniae
  CPn0457
VFLPSRVMASCLSAWFSIVREHFYRAFDFSLPFCARITEFVLGVIKGIPVVGHIIVGIEWLVSRYLESFVTKPTFVSDVVSLLKTEKVAGRDHIARVVETLKRQRVAVAPEDEDKVHGKIPVHPFGGIQPVEVLTLYPEVQDATLGLAFSKIRNRVRQAYLQAPRPKLQKIYIIGNDMNPFEVDDFLHLARLCNETQRLYPDATISLYLTASGGRNAMDKKNRKLLSDCELNPKIACLDFNQGDVVKQATCDCWMVYHGENDQGTLNQIQEELEKSGEETPWIHVGQKPLSQSLWDFSPFSSLEMKGDKEKALEYSELEKEQLYSRLVYVGERSSVLSLGFGDSRSGILMDPKRVHAPLSEGHYCHSYLADLENPGLQKTILAAFLNPKELSSTILQPISLNLILNSKTYLRQHFGFFERMSRSDRNVVVVVCDSWWGTDWKEEPSFQHFIMELECRGYSHFNIFAFRSNSMCVEERRILNESSQEKAFTMIFCEDSVSQGDIRCLHLASEGMLCGKECYAVDVYTSGCANFMMEEVLTLERESNLWNRKHGLWKREVRKQKQEAALDQDESEIYVCNQLTAQQNFACS

SEQ ID NO: 460 - protein, 703 aa, Chlamydia pneumoniae
  CPn0458
YFLCCYLKLFVSNFIFFVVMPIPYISSWISTVRQHFVKAFDFSRPFCSRVTNFALGVIKAIPIVGHIVMGMEWLVSSCVAGIITRSSFTSDVVQIVKTEKALGRDHISRVAEILQRERGTITPENQDKVHGKFPVCPFGRLKSEETLKLKPGEREGTLDTVFSPIRTRVTRAYLQAPRPEIRTISIVGSKLKTPQDFSQFVSLANETQRLHPEALVCLYLTGLNRESQMCDTTTAEKKQYLHNSGLDSRIQCKDSKEDDAGSPENPELWIGYYSREQQHNIDGQYIQQCLGKSADPIPWIHVTEDTKDFYYPPNFTSYSHTRQSTDPTSPPRLPESEGDKDSLYGQLSRSYHHEYMLGLGLKPEDAGLLMDPDRIYAPLSQGHYCHSYLADIENEDLRTLVLSPFLDPGNLSSEDLRPVAFNIARLPLELDSLFFRLVAGQQEGRNIVTLAHGTPRPEDLDPDSMNILTRRLQMSGYSYLNIFSYKSRKMIVKERQFFGDRSEGKSFTLILFEDPISAADFRCLQLAAEGMVAKDLPSVADICASGCSCIQFSEMQSPQAIEYRQWEARVEDEAGEEAREPVIYSQDQLSSMLTTQQNFVFSLDAVVKQAIWRFRSKGLLTMERKALGEEFLTAIFSYLGSQERNENMGKRTTEEHEVVISFEELDRMVQVLPAEVPADSGNDPTRPVPNPDSNPDSSQNEGS

SEQ ID NO: 461 - protein, 148 aa, Chlamydia pneumoniae
  CPn0459
STKIQMHPGLRNWRTSTNKLREEGSVSFREYFRAYMCDKIVAQKNFLFTLDAVIKQAGWRSQEKLNLFYVESQALGREIKVSLEEYIQSMVGILGSQRTKKSFKFSVDFTPLEQALQERCSSDDDEDATATSTATGATASPTDMHEDE

SEQ ID NO: 462 - protein, 283 aa, Chlamydia pneumoniae
  CPn0460
VIQHLLNFALEETPSISVQYQEQEKLSPCDHSPEIGKKKRWNKLESFSTYCSLFMSVKDHYKLNLGIQNSLSGWLLDPYRVCAPLSSPYSCPSYLLDLQNKELRRSLLSTFLDPKNLTSETFRSVSINFGNSSFGQRWSEFLSRVLHDEKEKHVAVVCNDAKLLEEGLSPEALSLLEEDLRESGYSYLNILSVSPEGVSKVQERQILRRDLQGRSFTVMITDLPLGSEDIRSLQLASDRILVSSSLDAADACASGCKVLVYENPNASWAQELENFYKQVERRR

SEQ ID NO: 463 - protein, 268 aa, Chlamydia pneumoniae
  CPn0461
ISIVACPSISSWFTVVRQHFVNAFDFTHPVCSRITNFALGIIKAIPVLGHIVMGIEWLISWIPRHTVRHGMFTSDVSSAIKVEQTRGHNCLAPLEAYLSSLRVPISQEDLGKVHGRTPEDPFVDITPTEIVQLLPDEELSTVDEALQGVRSRLTYAYRSVEKPMIQDLALVGFGLRDSADLINFVRLANGVQNHYPHTKVKLYLAKNLADVWDCEISEEEKGQLRALGLDPKIESISLTSAGLPSVPEVATVDFMITCYGKDQEVQDP

SEQ ID NO: 464 - protein, 696 aa, Chlamydia pneumoniae
  CPn0462
LIFYLFLNLYIACVRFHFQCWFDPMACYISIWISTVKQHFIRAFDFTRPLGSRITNFALGVIKAIPILGCVVIGVSWLVSTCSARRFGKPAFTSDVASIVKIEKTRGYNPLAWVEQYLRQLRVRLPEGDLGKIHGKVSRDYVCDRTPQENLNMVPHQYLGELGRAFYGIRNRVTKAYQRVTPLEVPCLTLVGFDILDPEDQVNFVRLANGIQTQYPQTQIKLYLISIQKIWNQCDGTISQEKEQQLRSLGLDAKIKCVSAPALLLQKYLQSENLPSCDLLINYYGKQQSVRDVDSIKSLLNLSSEHIPAISVTYRPDDPFYSYYFFPGSQGGTAPDQRIPWSEQEHLQTYTTLSNPRCDRYAVHLGMEDFASGVFLDPLRVSAPLSGEYSCPSYLLDLKSEELRCFLLSAFIDPNNSGQGNPRPMSINFGNSPLGQRWSEFLSRVLHDETEKHVAVVCNNPQLIKKSFPSHSLSLLENELEESGYSYLNIVSVSQERTCVKERRILSSDPSGRSFTVILTDLPEGSSDIRNLQLASDRILVSSALDAADACASECKILEYEDPEQEWAQQYASFYRNIDRAGDLQRQGIPGEPLGVSASTRVVLEKDIVFNLNAVIQQAMWKFKKRDLFAVESQALGDDMRRALEGYIGSSLLVEGTIQPQVACNVNVSFATLDEAVCAACDSAQDAPSEENNTDD

SEQ ID NO: 465 - protein, 430 aa, Chlamydia pneumoniae
  CPn0463
LSSPYEKTEQLLGTPNCRTPRVNISTVGIPIDETSNAFVDSMMKQGVGQDAKELYTFLSRGNEHYQPCLWFSLEEELGFLFDEKMLCAPLSEDHYCHSYLVDLVDQHLKDLILSMFLDPQNISAGELLKVSINVGDSFSPLQQKDFLSMVLRDETGKNVVVVFKGVLSLPATQVCKLVEELNSKDYSYLNIFSCHGDSSPQLLFRKELEGTSGRYFTVICALYLGDTDMRSLQLASERIMVSREFDLVDAYAARCKLLKIDHTNWRPGTFSRHADFADAVDVSAGFNSREFKLITQANQGILESGELPLPSKTFWEGFLAFCDRVTVTRHFIPMLDAAIKQAVWTHKHPSLIDKECEALDLKTQCLPSIVSYLEYVTNSHEKTSKGPFIQKEIIADCSPLKEALFPGSDEDVPSTSEDPSDDHPSDLEDS

SEQ ID NO: 466 - protein, 186 aa, Chlamydia pneumoniae
  CPn0464
SLETRGRFTEICLQLLFFDIQSLKFLQLFSEGTALNLFRIFAPLRNRVTTEYSRARQPDLHRIAIVYIGVLDSESSKILERLISYMSCIYSESQMYLRFFMGKNVNQSAVLSKLHVENLHIRCGFFSEDAVPESEPFDLSIYVHTDRSCPLPTKKRSSSWELQTVELPESIYPQSEFLLMRPRMLS

SEQ ID NO: 467 - protein, 136 aa, Chlamydia pneumoniae
  CPn0465
LLENNRFFLFFKVKYFLKDSFLMSYYFSLWYLKVQQHFQAAFDFTRSLCSRISNFALGVIALLPIIGQLYVGLDWLLSRIKKPEFPSDVDQIVRVEHVVGHDHRSRVEDILKRQRLSLEPRDEGKVHGDLPSAPFF

SEQ ID NO: 468 - protein, 940 aa, Chlamydia pneumoniae
  CPn0466
TSMRFFCFGMLLPFTFVLANEGLQLPLETYITLSPEYQAAPQVGFTHNQNQDLAIVGNHNDFILDYKYYRSNGGALTCKNLLISENIGNVFFEKNVCPNSGGAIYAAQNCTISKNQNYAFTTNLVSDNPTATAGSLLGGALFAINCSITNNLGQGTFVDNLALNKGGALYTETNLSIKDNKGPIIIKQNRALNSDSLGGGIYSGNSLNIEGNSGAIQITSNSSGSGGGIFSTQTLTISSNKKLIEISENSAFANNYGSNFNPGGGGLTTTFCTILNNREGVLFNNNQSQSNGGAIHAKSIIIKENGPVYFLNNTATRGGALLNLSAGSGNGSFILSADNGDIIFNNNTASKHALNPPYRNAIHSTPNMNLQIGARPGYRVLFYDPIEHELPSSFPILFNFETGHTGTVLFSGEHVHQNFTDEMNFFSYLRNTSELRQGVLAVEDGAGLACYKFFQRGGTLLLGQGAVITTAGTIPTPSSTPTTVGSTITLNHIAIDLPSILSFQAQAPKIWIYPTKTGSTYTEDSNPTITISGTLTLRNSNNEDPYDSLDLSHSLEKVPLLYIVDVAAQKINSSQLDLSTLNSGEHYGYQGIWSTYWVETTTITNPTSLLGANTKHKLLYANWSPLGYRPHPERRGEFITNALWQSAYTALAGLHSLSSWDEEKGHAASLQGIGLLVHQKDKNGFKGFRSHMTGYSATTEATSSQSPNFSLGFAQFFSKAKEHESQNSTSSHHYFSGMCIENTLFKEWIRLSVSLAYMFTSEHTHTMYQGLLEGNSQGSFHNHTLAGALSCVFLPQPHGESLQIYPFITALAIRGNLAAFQESGDHAREFSLHRPLTDVSLPVGIRASWKNHHRVPLVWLTEISYRSTLYRQDPELHSKLLISQGTWTTQATPVTYNALGIKVKNTMQVFPKVTLSLDYSADISSSTLSHYLNVASRMRF

SEQ ID NO: 469 - protein, 969 aa, Chlamydia pneumoniae
  CPn0467
NEILTISDQNRKIKEPLVSKTPPKFLFYLGNFTACMFGMTPAVYSLQTDSLEKFALERDEEFRTSFPLLDSLSTLTGFSPITTFVGNRHNSSQDIVLSNYKSIDNILLLWTSAGGAVSCNNFLLSNVEDHAFFSKNLAIGTGGAIACQGACTITKNRGPLIFFSNRGLNNASTGGETRGGAIACNGDFTISQNQGTFYFVNNSVNNWGGALSTNGHCRIQSNRAPLLFFNNTAPSGGGALRSENTTISDNTRPIYFKNNCGNNGGAIQTSVTVAIKNNSGSVIFNNNTALSGSINSGNGSGGAIYTTNLSIDDNPGTILFNNNYCIRDGGAICTQFLTIKNSGHVYFTNNQGNWGGALMLLQDSTCLLFAEQGNIAFQNNEVFLTTFGRYNAIHCTPNSNLQLGANKGYTTAFFDPIEHQHPTTNPLIFNPNANHQGTILFSSAYIPEASDYENNFISSSKNTSELRNGVLSIEDRAGWQFYKFTQKGGILKLGHAASIATTANSETPSTSVGSQVIINNLAINLPSILAKGKAPTLWIRPLQSSAPFTEDNNPTITLSGPLTLLNEENRDPYDSIDLSEPLQNIHLLSLSDVTARHINTDNFHPESLNATEHYGYQGIWSPYWVETITTTNNASIETANTLYRALYANWTPLGYKVNPEYQGDLATTPLWQSFHTMFSLLRSYNRTGDSDIERPFLEIQGIADGLFVHQNSIPGAPGFRIQSTGYSLQASSETSLHQKISLGFAQFFTRTKEIGSSNNVSAHNTVSSLYVELPWFQEAFATSTVLAYGYGDHHLHSLHPSHQEQAEGTCYSHTLAAAIGCSFPWQQKSYLHLSPFVQAIAIRSHQTAFEEIGDNPRKFVSQKPFYNLTLPLGIQGKWQSKFHVPTEWTLELSYQPVLYQQNPQIGVTLLASGGSWDILGHNYVRNALGYKVHNQTALFRSLDLFLDYQGSVSSSTSTHHLQAGSTLKF

SEQ ID NO: 470 - protein, 275 aa, Chlamydia pneumoniae
  CPn0468
IYKLLDNKLMIFYDKLYFHIKVWMFMRPICLSILSTALCCSLSGNEVPNLASCQMSRKDISAFHTSPSFRLNVTPEPLVSSFRPSNLLNGFGHDITQDITITGNSINSVIDYNYHYEDGGILACKNLFISENKGNLSFERNSSHSSGGALYSVRECWISKNQNYSFISNAASLATTTTSGFGGAIHALDSYITNNLGEGQFLDNVSKNRGGAIYVGVSLSITDNLGPIVIKKNQTLEDSSFGGGIFCRAVNIERNYQNIQINDNASGQGVVYFLP

SEQ ID NO: 471 - protein, 354 aa, Chlamydia pneumoniae
  CPn0469
CFRTRGGIFSALGVIISSNKEIIEISNHSASSINTASGKLYPGGGGIMCTSLVIENNPKGLIFNNKTAALSGGAIHTRSFIFQNNGPTAFINNSATSGGALINLSGIGSTPQNFFLSADYGDILFNNNTITSSSPQPGYRNALYAAPGINLKLGARQGYKILFYDPIDHDQTTTDPIVFNYEPHHLGTVLFSGINVDSNATNPLNFLSKFSNSSRLERGVLAIEDRAAISCKTLSQTGGILRLGNAALIRTKGPGSSINFNAIAINLPSILQSEASAPKFWIYPTLTGSTYSEDTSSTITLSGPLTFLNDENENPYDSLDLSEPRKDIPPPLPPRCDCKKNRYFESHCRSHELR

SEQ ID NO: 472 - protein, 392 aa, Chlamydia pneumoniae
  CPn0470
ISLNLERISPLLYLLDVTAKKIDTSNLIVEAMNLDEHYGYQGIWSPYWMETTTTTSSTVPEQTNTNHRQLYVDWTPVGYRPNPERHGEFIANTLWQSAYNALLGIRILPPQNLKEHDLEASLQGLGLLINQHNREGRKGFRNHTTGYAATTSAKTAARHSFSLGFAQMFSKTRERQSPSTTSSHNYFAGLRFDSLLFRDFISTGLSLGYSYGDHHMLCHYTEILKGSSKAFFNNHTLVASLDCTFLPARITRTLELQPFISAIALRCSQASFQETGDHIRKFHPKHPLTDLSSPIGFRSEWKTSHHIPMLWTTEISYVPTLYRKNPEMFTTLLISNGTWTTQATPVSYNSVAAKIKNTSQLFSRVTLSLDYSAQVSSSTVGQYLKAESHCTF

SEQ ID NO: 473 - protein, 947 aa, Chlamydia pneumoniae
  CPn0471
TVQNNRSLSKSSFFVGALILGKTTILLNATPLSDYFDNQANQLTTLFPLIDTLTNMTPYSHRATLFGVRDDTNQDIVLDHQNSIESWFENFSQDGGALSCKSLAITNTKNQILFLNSFAIKRAGAMYVNGNFDLSENHGSIIFSGNLSFPNASNFADTCTGGAVLCSKNVTISKNQGTAYFINNKAKSSGGAIQAAIINIKDNTGPCLFFNNAAGGTAGGALFANACRIENNSQPIYFLNNQSGLGGAIRVHQECILTKNTGSVIFNNNFAMEADISANHSSGGAIYCISCSIKDNPGIAAFDNNTAARDGGAICTQSLTIQDSGPVYFTNNQGTWGGAIMLRQDGACTLFADQGDIIFYNNRHFKDTFSNHVSVNCTRNVSLTVGASQGHSATFYDPILQRYTIQNSIQKFNPNPEHLGTILFSSTYIPDTSTSRDDFISHFRNHIGLYNGTLALEDRAEWKVYKFDQFGGTLRLGSRAVFSTTDEEQSSSSVGSVININNLAINLPSILGNRVAPKLWIRPTGSSAPYSEDNNPIINLSGPLSLLDDENLDPYDTADLAQPIAEVPLLYLLDVTAKHINTDNFYPEGLNTTQHYGYQGVWSPYWIETITTSDTSSEDTVNTLHRQLYGDWTPTGYKVNPENKGDIALSAFWQSFHNLFATLRYQTQQGQIAPTASGEATRLFVHQNSNNDAKGFHMEATGYSLGTTSNTASNHSFGVNFSQLFSNLYESHSDNSVASHTTTVALQINNPWLQERFSTSASLAYSYSNHHIKASGYSGKIQTEGKCYSTTLGAALSCSLSLQWRSRPLHFTPFIQAIAVRSNQTAFQESGDKARKFSVHKPLYNLTVPLGIQSAWESKFRLPTYWNIELAYQPVLYQQNPEINVSLESSGSSWLLSGTTLARNAIAFKGRNQIFIFPKLSVFLDYQGSVSSSTTTHYLHAGTTFKF

SEQ ID NO: 474 - protein, 778 aa, Chlamydia pneumoniae
  CPn0472
EVFMASGIGGSSGLGKIPPKDNGDRSRSPSPKGELGSHEISLPPQEHGEEGASGSSHIHSSSSFLPEDQESQSSSSAASSPGFFSRVRSGVDRALKSFGNFFSAESTSQARETRQAFVRLSKTITADERRDVDSSSAAATEARVAEDASVSGENPSQGVPETSSGPEPQRLFSLPSVKKQSGLGRLVQTVRDRIVLPSGAPPTDSEPLSLYELNLRLSSLRQELSDIQSNDQLTPEEKAEATVTIQQLIQITEFQCGYMEATQSSVSLAEARFKGVETSDEINSLCSELTDPELQELMSDGDSLQNLLDETADDLEAALSHTRLSFSLDDNPTPIDNNPTLISQEEPIYEEIGGAADPQRTRENWSTRLWNQIREALVSLLGMILSILGSILHRLRIARHAAAEAVGRCCTCRGEECTSSEEDSMSVGSPSEIDETERTGSPHDVPRRNGSPREDSPLMNALVGWAHKHGAKTKESSESSTPEISISAPIVRGWSQDSSVSFIVMEDDHIFYDVPRRKDGIYDVPSSPRWSPARELEEDVFGDYEVPITSAEPSKDKNIYMTPRLATPAIYDLPSRPGSSGSSRSPSSDRVRSSSPNRRGVPLPPVPSPAMSEEGSIYEDMSGASGAGESDYEDMSRSPSPRGDLDEPIYANTPEDNPFTQRNIDRILQERSGGASASPVEPIYDEIPWIHGRPPATLPRPENTLTNVSLRVSPGFGPEVRAALLSESVSAVMVEAESIVPPTEPGDGESEYLEPLGGLVATTKILLQKGWPRGESNA

SEQ ID NO: 475 - protein, 511 aa, Chlamydia pneumoniae
  CPn0473
GSIMAVGGVGGSRSPSPIPPNRRNSEDGKVSPKDNLGEHTVSSSDSSLASQGPTIEERKAQLGGTDKIPLPSVKEPGDSQTSGRSGVLQRIWKGVKGVFKKTPQARPEVSSPRLPSHVQHGQRLPGLEGFRDRIQKRSENPEADLGKMKRSYSDGDLDRVGHDSNEDSTEDSRSEGGEPSSKSSSFLSGVRGAVSKVHGALGDIKGKFQRSASEDDLTTQGEDSAGDTVKERRSEEAEASSKSSSFLSGVRGATSTVQGALGDAKEKVSAFGEQAAGAIRSAPGNIRTRFQRSSSEGDLSNVNKAAKHLRKALENLEKVAPEQVSPEVASRVQSLLARMEQLTHQEPPTVEDLITFVESNVGSDSVEYASIVPQDGSQAPAETAEAPETGGVEGSAAQGAWKALRDFVVSIFQAVASFFRAIASRLSSARRESAVDDLASESNTQWFVEQEGVSNPSAAPSLSFAEEIARRAAEMSNRNAQSLEKLESGNVTDPVIQQGLGLARSFAPEGQ

SEQ ID NO: 476 - protein, 598 aa, Chlamydia pneumoniae
  CPn0474
LKIIISISFMSTSPISNDPRYLSLSNATEKTSLLANSRSLSPVPNSLVPSNPEDTGLRKSIFTHSVTLFAGLVVLLVAVSVVVVALTVLAPGVPQAILLGIAISGVGIGGFSIMKSLVYMVRDYMSPRMQESSRIKSALAVGTGFTVMGLVMKVGANFVPGGYGGLVGSLGSSAYSRGSQTTLASFSHYIYTKFFRSEKVAKGEKLTEAETIKEAKKLHYITLSIATIGVGLAVLGILLAIAGTVLLGGAPATIAIILAPPLISIGLTTVLQTILHSSIGKWRAFLLTQEKKDLFVDTSLKDIRLEKLPPSEVEESETSQSVIEVPDSEGIAETRISAEEIDTRLSLTTRQKVIFALATLLLLASIAAFIVTGFGGLTVMQVLLVASVGSAVASVTLPMVSSGFSYVAYQLKARLNISKLRWKEAKNKKRVRQFLIESGVIASDREFNQMWKTVYKKQIQKTDAAIREEVRNFEKGGEVNSALVGGILLGVGTGIMLLALVPAFAPIVPGILALGGSTLGIAGSILMRKFVNWLYDELVKLYERRRNRRELLYGPESKMRSIATDLVVEALAASHDHLFDLDGPVDFIDVDVDIDGAA

SEQ ID NO: 477 - protein, 722 aa, Chlamydia pneumoniae
  CPn0475
PSMVDKLIHPWDLDLLVSGRQKDPHKLLGILASEDSSDHIVIFRPGAHTVAIELLGELHHAVAYRSGLFFLSVPKGIGHGDYRVYHQNGLLAHDPYAFPPLWGEIDSFLFHRGTHYRIYERMGAIPMEVQGISGVLFVLWAPHAQRVSVVGDFNFWHGLVNPLRKISDQGIWELFVPGLGEGIRYKWEIVTQSGNVIVKTDPYGKSFDPPPQGTARVADSESYSWSDHRWMERRSKQSEGPVTIYEVHLGSWQWQEGRPLSYSEMAHRLASYCKEMHYTHVELLPITEHPLNESWGYQVTGYYAPTSRYGTLQEFQYFVDYLHKENIGIILDWVPGHFPVDAFALASFDGEPLYEYTGHSQALHPHWNTFTFDYSRHEVTNFLLGSALFWLDKMHIDGLRVDAVASMLYRDYGREDGEWTPNIYGGKENLESIEFLKHLNSVIHKEFSGVLTFAEESTAFPGVTKDVDQGGLGFDYKWNLGWMHDTFHYFMKDPMYRKYHQKDLTFSLWYAFQESFILPLSHDEVVHGKGSLVNKLPGDTWTRFAQMRVLLSYQICLPGKKLLFMGGEFGQYGEWSPDRPLDWELLNHHYHKTLRNCVSALNALYIHQPYLWMQESSQECFHWVDFHDIENNVIAYYRFAGSNRSSALLCVHHFSASTFPSYVLRCEGVKHCELLLNTDDESFGGSGKGNRAPVVCQDQGVAWGLDIELPPLATVIYLVTFF

SEQ ID NO: 478 - protein, 340 aa, Chlamydia pneumoniae
  CPn0476
GRGRRADWGDCMIDIMQHFKPYTMVPGQKLPIPGSLLYAQVFPTLWRLFSSKHEILNEQTLQVQGPLKRFAVFQDLHRGGLAVTSERYKYYLLPSGECTQSIKGKLPSAAQAGPLLSLGVHKHADWQKVRCRRDLKEILPLWFRFAAMAPKGSYRDLETTAIGSLVKTAHQRVLHRETTEIAPALLSIALAGFSECFLPRSYDEEFQGILPQDGDPEGGVPFELLSYSFGMIQDIFLRHQGQLVEILPALPPEFPCGRLIHVALPNLGTLSIVWTKKTIRQVELHAEYSGEVFLKFCSSLCSARLREWSERRLSGSKRLSLGETLEIKAGTTYLWDCFHK

SEQ ID NO: 479 - protein, 423 aa, Chlamydia pneumoniae
  CPn0477
RYMTVAEVKGTFKLVCLGCRVNQYEVQAYRDQLTILGYQEVLDSEIPADLCIINTCAVTASAESSGRHAVRQLCRQNPTAHIVVTGCLGESDKEFFASLDRQCTLVSNKEKSRLIEKIFSYDTTFPEFKIHSFEGKSRAFIKVQDGCNSFCSYCIIPYLRGRSVSRPAEKILAEIAGVVDQGYREVVIAGINVGDYCDGERSLASLIEQVDRIPGIERIRISSIDPDDITEDLHRAITSSRHTCPSSHLVLQSGSNSILKRMNRKYSRGDFLDCVEKFRASDPRYAFTTDVIVGFPGESDQDFEDTLRIIEDVGFIKVHSFPFSARRRTKAYTFDNQIPNQVIYERKKYLAEVAKRVGQKEMMKRLGETTEVLVEKVTGQVATGHSPYFEKVSFPVVGTVAINTLVSVRLDRVEEEGLIGEIV

SEQ ID NO: 480 - protein, 477 aa, Chlamydia pneumoniae
  CPn0478
WHGGPLDTIDTPGEQGSQSFGNSLGARFDLPRKEQDPSQALAVASYQNKTDSQVVEEHLDELISLADSCGISVLETRSWILKTPSASTYINVGKLEEIEEILKEFPSIGTLIIDEEITPSQQRNLEKRLGLVVLDRTELILEIFSSRALTAEANIQVQLAQARYLLPRLKRLWGHLSRQKSGGGSGGFVKGEGEKQIELDRRMVRERIHKLSAQLKAVIKQRAERRKVKSRRGIPTFALIGYTNSGKSTLLNLLTAADTYVEDKLFATLDPKTRKCVLPGGRHVLLTDTVGFIRKLPHTLVAAFKSTLEAAFHEDVLLHVVDASHPLALEHVQTTYDLFQELKIEKPRIITVLNKVDRLPQGSIPMKLRLLSPLPVLISAKTGEGIQNLLSLMTEIIQEKSLHVTLNFPYTEYGKFTELCDAGVVASSRYQEDFLVVEAYLPKELQKKFRPFISYVFPEDCGDDEGRGPVLESSFGD

SEQ ID NO: 481 - protein, 273 aa, Chlamydia pneumoniae
  CPn0479
AIGMVRDIQSESIGKLVFLGTGNPEGIPVPFCSCRVCQNTGIHRLRSSVLIQYQNKTLVIDAGPDFRTQMLVAGVSELDGVFLTHPHYDHIGGIDDLRAWYIVTQRSLPLVLSASTYRFLNKAKEYLFATPNVESSLPAVLEFTILNEDCGQEEFQGIPYTYVSYYQKSCHVTGFRFGNLAYLTDLCSYDAKIFSYLDNVETLILSAGPSETPIPFQGHKSSHLTVEEAKAFANHAGIKNLIITHISHCLEAERDQHPEVTFAYDGMEVLWTL

SEQ ID NO: 482 - protein, 242 aa, Chlamydia pneumoniae
  CPn0480
SDERISWGISGRLGEFVSKKEQDCMLGSLPCYPGAGNIEEYKNRYFYCQLCAEVVSPYVVPVIVVDVQGAPPTGILQVLRCKQHKFQGLPVHGPITSLWALEPVGKGAPQLESAMYELCSQVRNFDICSIVSWVFGGLCIFAGLIVGVMVEAPLIAGLSAWVIPCIIGGVGAILCLFAILMAYLGRGRVREWLNLSHEYITQCHCRQIQAHSQNYSVITEYPATCALSQPITKLPNGSRRDN

SEQ ID NO: 483 - protein, 545 aa, Chlamydia pneumoniae
  CPn0481
SCLRIEGILMATSVPVTSSTSVGEANSSNERFTERTSRMYYAALVLGALSCLIFIAMIVIFPQVGLWAVVLGFALGCLLLSLAIVFAVSGLVLGKTLEPSREATPPEIVAQKEWTTQQDVLGNEYWRSELISLFLRGDLHESLIVDSKDRSLDIDQSLQNILKLEPLSTTLSLLKKDCVHINIILHLVRQWNLLGVDLSPEVTAHAEELLLFLIEEQYYSPDILKLIRYGDALQATSPLMDWADSGSFSVDADGVFSCRREECSPEDALAQFDLLLALENPDRRFLKDSFLTYIWSSSFFEKFLHRHLESLQRKLPETAIDVARYEAQIQTFLSRYFQKLDLINAMSLDWGYNCAEGEKCYESANQRLDNLFIAFSSSVPAMKRLFDKYGSVVRVDRRQIREQILSNTEILENESGFLCSLYEYPLSYLIDWAVLLDCVRGTEISLEDQADYTVCLQGLDSMLSQFASRLQSGQKVLNPRDVLSEQAAVMLVHGLAAQGVSFQGLKALMYLTAVPQRMWLGALPLFESFPVFNRMKEFLGESLGD

SEQ ID NO: 484 - protein, 268 aa, Chlamydia pneumoniae
  CPn0482
NLAYRAQTFMIKQIGRFFRAFIFIMPLSLTSCESKIDRNRIWIVGTNATYPPFEYVDAQGEVVGFDIDLAKAISEKLGKQLEVREFAFDALILNLKKHRIDAILAGMSITPSRQKEIALLPYYGDEVQELMVVSKRSLETPVLPLTQYSSVAVQTGTFQEHYLLSQPGICVRSFDSTLEVIMEVRYGKSPVAVLEPSVGRVVLKDFPNLVATRLELPPECWVLGCGLGVAKDRPEEIQTIQQAITDLKSEGVIQSLTKKWQLSEVAYE

SEQ ID NO: 485 - protein, 1045 aa, Chlamydia pneumoniae
  CPn0483
IILIKKRAIFERMFPIPPPHCPPNNKNNFYHLTTDTKDPLLLRILRTIGYVLLHIITLGLLLLIHYYKHHRVVRKEGLPTPPTLPKGPEPKTIEIAKQPPKDGEDKKPDVPKPGTPPPEDTPPPPPKAPSPASPKVPKQPADKKPTPPPEAPPPPVRVATPMPLRPSSQGYWQCLNRMVSMVLRRAPLPLPAMQVDPILGDFNPHFVASYPNRIDNEPMYFQIKQFKKIAQNPDLPQQHRRLAQLSLEQALYLNDNYYLVNVPGDGNCFYRAYAVGWLSALYEESSRNDIVFEQEATRLLDLPFASSSPANANLCAEMAELLQLCSTYCSFIDLYDGVILSQKHTATLIAFLRKLSAYAIRQQIAASSNEETARALFISDMQDDLLPSVLEFLAANRPYSELFQNLIDHSALPYMQSRDKLFLLLEHLPALFLTDAELQKMSPEDQQLRKQYEREIREAFAKLSRRIADSGWDTERFNAIVKDHLPEAIRCQYSRFLATIENRRSGDLPWSPALSFFAFLCTCPSVRFHKLCATFYKSLEDIIIASAPPQRSIQEILQISNASLSYLNEDLDSSWQREVISSNIMTILTTHESLTLESSMPQLETLHKRIANLLKNVISTSFETPPLSNQPDLLSNLVNKLLVAIHSKLELKEHFNTVCSARSLRLTRDEGSGLSQEQDLLYTQAVQLLFFILQHPQVNNRPETKDAVKELKMLLLPFLQYAFKKVENEKKLQKLLRSILGSLVLKPPARYPSTPSNKDKETFCKFWSRHPEVMVLDPILEKNCMQFLRATFPNYQLETEAILLEKEIESTFRNGWNVFLTRLNLFGSKLGSPSSPTALSDQFSKSFLIFCFLNNYPKLLQKKTPLAARLDAFQREASHRFTQVKDKLLLSLKYGFPLATATINQYSRARDQLICNLLKNTVTASDGFCRSGFRQSLIGYLHSLSSNELGDILDDVKEQAEANDVAAMTTVPLQPFAVCLIMSDRDTVSEENIENFVAMHGFLNTISPERDARIFLIRFPNHYGCLLPRNPRTEDQNSKPDSSNP

SEQ ID NO: 486 - protein, 298 aa, Chlamydia pneumoniae
  CPn0484
RSELKTGQLKSLVLHEVLILTFTYPLPRTLKQHPDEVHTVPISPNLSFGEGSPILIAGPCTLESYEHTVSSALTVKEAGAQVFRGSIRKPRTSPFSFQGWEKECVLWHKEAQSIHGLPTETEVLDVRDVEITAEHVDILRIGAKNMHNTPLLQEVSKSHRPIILKRSPAATLEEWLCAAEYILASSPSCPGVILCERGIRTFEHSTRYTLDLNTVALLKEISSLPVIVDPSHAAGKRSLVLPLASAGLSVGADGLMIEVHAHPEKALCDAKQQITPEELHLFAKKHFCPSESRAHAIS

SEQ ID NO: 487 - protein, 79 aa, Chlamydia pneumoniae
  CPn0485
QPIGRTPTRVFLWRFMIKQACKFYLLQCLLCALYWLLKYCRKLLKGTLHHSEETLYQALLSSLIDLLYQLKQLPAPTNE

SEQ ID NO: 488 - protein, 465 aa, Chlamydia pneumoniae
  CPn0486
AQHRSLLKGNIFHLGCGVLYFMNFSLFLFFLIAIQGICLYVGRRGSKKVEDRESYFLAGRSLKIFPLMMTFIATQIGGGVLLGAAEEAFCYGYGGILYPLGVALGLIFLGMGPGKRLAEGSLTTVVSIFEVFYGSKKLRKIAFLLSAGSLFFILVAQVIALDRLFSSFPFGKYVTVAFWIVLASYTSTGGFRGVVRTDVIQAGFLLIAVLVCGVSVWLSVPKSLSVLDPFQSLPCAKLSNWIFMPMLFMLVEQDMVQRCVAASSPKRLQWAAVGAGLVLLLFNFIPLFLGSLGAKAGLKAGCPLIDTIAYFCNPSLAAVMAAAIGVAILSTADSLMNAVSQLIAEEYPTLKAPYYRYLVLGLAVAAPLVAIGFTNIVDVLILSYSLSVCCLSVPVGFYLLAPKGRRVSGAAAWAGVLVGALGYGWVQIVSLGMFGELLAWVGSLVAFSFVGFIEITWKNKVKTQT

SEQ ID NO: 489 - protein, 574 aa, Chlamydia pneumoniae
  CPn0487
RRTGGISLTYSSFRWASFRCYSLIFFCFCGSLFGSESLRYQLLIQDFAKVSEEGIGLLESKEYSLLQAKLVLRALAQNSSFDDWFRSFKKCQISYPELAHDRDVLEEFGIQVLREGIENPSVTVRAVSVLAIGLARDFRLVPLLLQSCNDDSAIVRSLALQVAVNYGSESLKKAIVELARNDDSIHVRITAYQVVALLQIEELLPFLRERAENKLVDSVERREAWKACLELSSQFLETGVAKDDIDQALFTCEVLRNGMLPETTEIFTELLSVEHPEVQESLLLSALAWSHQLQNHKEFLSKVRHVMCTSPFAKVRFQAAALLHLHGDPLGRDSLVEGLRSPQPLVCEAASAALCSLGIHGVPLAKEHLESLSSRKAAANLSILLLVSREDIERAGDVIARYLSNPEMCWAIEYFLWDAQWNLRGDTFPLYSDMIKREIGRKLIRLLAVARYSQAKAVTATFLSGQQAQGWSFFSGMFWEEGDVKTSEDLVTDACFAAKLEGALASLCQKKDQASLQRVSQLYNDSRWQDKLAILESVAFSENLDAVPFLLDCCHHEAPSLRSAAAGALFSIFK

SEQ ID NO: 490 - protein, 127 aa, Chlamydia pneumoniae
  CPn0488
RKLPTCFAVNVTRSRDHMTVFKQIIDGLIDCEKVFENENFIAIKDRFPQAPVHLLIIPKKPIPRFQDIPGDEMILMAEAGKIVQELAAEFGIADGYRVVINNGAEGGQAVFHLHIHLLGGRPLGAIA

SEQ ID NO: 491 - protein, 314 aa, Chlamydia pneumoniae
  CPn0489
RIVFAIENYFSLVTMEDWLRRIVGMQIPRSIGTHDGSFHADEVTACALLIIFDLVDENKIIRSRDPVVLSKCEYVCDVGGVYSIENKRFDHHQVSYDGSWSSAGMILHYLKEFGYMDCEEYHFLNNTLVHGVDEQDNGRFFSKEGFCSFSDIIKIYNPREEEETNSDADFSCALHFTIDFLCRLRKKFQYDRVCRGIVREAMETEDMCLYFDRPLAWQENFFFLGGEKHPAAFVCFPSCDQWILRGIPPNLDRRMDVRVPFPENWAGLLGKELSKVSGIPGAVFCHKGLFLSVWTNRESCQRALRLTLQDRGII

SEQ ID NO: 492 - protein, 686 aa, Chlamydia pneumoniae
  CPn0490
IMYNLLHAHHDAASPDGRLVSHLKKLSPHIYEGEVLIENIPAYFLGFHLPQQCIQVNLKSSLAQLGVEAVLNHLELNKARKEARLHVLFMSQDPIATAMLELLEPGSFVCKLFAADDRRLVRSPCYLNRMFTHTDRTGSPLLRFGKKLEHFITLEIINDRLVVFLPILPGTICYEETIYGFLPLMSKSLTRPHLKIRKFLPLYQMVTDRPPVPEDHKILLIKTEPLHIRTVFARVVQDLLPQGLRHTAADILEPTTQESGDIYEFYGSTSEPIERIPLEFFTLEPYKEHSFFFYRDMLQETLESPQEVFRVFESIPEGEDQAAMFISKGSELLELSQDSWIIKPRISPSDERHAREIQKHIEDQPCFPFLKAMETDHITSQGVLFSRYFPSASLKGMFLSNYSRYYLQHIYFQIPSPTSGEFFSNRDRSFLLDLYFAGISVFWADLESKRLLQYIKRRNKDVGMFVPKHQAEQFAQSYFIGIHGSCLIAGDYDEFLRELLTGMHTLSQQFTIPEFPPQTPLAILTGGGSGAMELANRVATELSILSCGNLISLDTTNAYVEAKMSYAIPDLLERQADFHVDLAVFVIGGMGTDFELLLELISLKTGKKALVPVFLIGPVDYWKSKITALYNSNHAVGTIRGSEWVHNCLFCLSSAKAGIAIFRRYLNHTLPIGPEHPVPEDGFVIV

SEQ ID NO: 493 - protein, 420 aa, Chlamydia pneumoniae
  CPn0491
ILSSLYTVFTMKTAFHSCYSWFCWLFSFLVLFVGGIAGGEPLCPDCKYETKSVLRSDQLPDHLWNYENDCYLTGYVQSLLDMHFLDSRTQVVIEKNRAYLFSLPVDSSLSEAITNFVRDLPFICAVEICERPYGECITRSSAERPLLPKEKTLGMPIFCGKEGVWLPQNTILFSPLIADPRQVTNSAGIRFNEKVVGNRVGATIFGGDFILLRLFDVSRFHVDCDFGIQGGVFSVFDLDHPESCMVNSDFFVAGLWSGAIDKWSFRFRLWHLSSHLGDEFILTHPNFPRFNLSDEGVDLFISFRYTPQIRLYGGCGYIVSRDLTFPERPFYCEWGAELRPFGLREGNLHAQPIFAMHFRCWEEQKFGLDQSYILGMEWAKFQEIGRKIRAVLEYHQGFSKEGQFIREPCNYYGFRLTYGF

SEQ ID NO: 494 - protein, 54 aa, Chlamydia pneumoniae
  CPn0492
LFSLIFPICEERNSQQTYKHLHVESACFLLESPLKIHWSSPYGFPPFYRRDLKL

SEQ ID NO: 495 - protein, 96 aa, Chlamydia pneumoniae
  CPn0493
SKTEGSHSKTSKGFVGRFVQWIRTFTGRGSKKRSPSSFSPTHPYIRLRTYTRSPKQSGVERKQEDAETSFIETPKGILKKPGNKDPKGKHVHWKDS

SEQ ID NO: 496 - protein, 75 aa, Chlamydia pneumoniae
  CPn0494
VIMIRVNPYGSYRGRNPSPEDGKKDVPLSGNSRLHRRGGIRRKHKSASVGVTSGSKTGKASLEKKVKGISEAHFK

SEQ ID NO: 497 - protein, 429 aa, Chlamydia pneumoniae
  CPn0495
RRLKKNQKMAIQKAGAFLRCLPSESRPYLEHAMRRNPHFSLLKPQYLFSEISKKLAQFRKENPEISVIDLSIGDTTQPLCRSITQAIKEFCVSQEKQETYRGYGPETGLEKLRTKIASEVYENRISPEEIFISDGAKPDIFRLFSFFGSEKTLGLQDPVYPAYRDIAHITGIRDIIPLACRKETGFIPELPNQQSLDILCLCYPNNPTGTVLTFQQLQALVNYANQHGTVLIFDAAYSAFVSDPSLPKSIFEIPEAKYCAIEINSFSKSLGFTGMRLAWNVIPKELTYDNNEPMINDWKRLFATTFNGASLLMQEAGYYGLDLFPTPPAISLYLTNAQKLKKSLETAGFSVHGGDHAPYLWVELPEGISDEEAFDFFLHQYHIAVTPGHGFGSCGQGFVRFSALTQPQNIALACDRLCTASLKETMVLA

SEQ ID NO: 498 - protein, 354 aa, Chlamydia pneumoniae
  CPn0496
PPLYRFTKRNDGSCMTILRKLSQYLFFFSLFCSFIYVATCGSQPDSVSSPKIAIFLSFPHPLLEDCSKSCIETLKDFENLPEIVVLNAEDSIVKARKIARSLHTDKNVVAIVTLGTIATKVMSHIETQKPVIYAAVPDRESLTLPKNTMNIYGVNDTLDINQYCFAIQAVATNAQSIVYLKPSEPFPSDLQKEIVKKLHASGIEVIEISITSSTFKTRIRQAIDKRPSAIFIPLSPLSHKEGTAFLQEILKEKIPIITDDTSLISEGACIACSVDYKKSGKQIAKIVHHLLYNNHDVDSLRKIIAQRLSPTTTFNEDIIKYLGIKLHKTERNQFLSFKSKKLEKSEKGKNVAVS

SEQ ID NO: 499 - protein, 96 aa, Chlamydia pneumoniae
  CPn0497
IFQRVVLDDSWILEVKVTPKAKENKIVGFDGQALKVRVTEPPEKGKANDAVISLLAKALSLPKRDVTLIAGETSRKKKFLLPNRVQDIIFSLHIDV

SEQ ID NO: 500 - protein, 326 aa, Chlamydia pneumoniae
  CPn0498
YCRLRRAPFMNRRKARWVVALFAMTALISVGCCPWSQAKSRCSIDKYIPVVNRLLEVCGLPEAENVEDLIESSSAWVLTPEERFSGELVSICQVKDEHAFYNDLSLLHMTQAVPSYSATYDCAVVFGGPLPALRQRLDFLVREWQRGVRFKKIVFLCGERGRYQSIEEQEHFFDSRYNPFPTEENWESGNRVTPSSEEEIAKFVWMQMLLPRAWRDSTSGVRVTFLLAKPEENRVVANRKDTLLLFRSYQEAFPGRVLFVSSQPFIGLDACRVGQFFKGESYDLAGPGFAQGVLKYHWAPRICLHTLAEWLKETNGCLNISEGCFG

SEQ ID NO: 501 - protein, 400 aa, Chlamydia pneumoniae
  CPn0499
LSVYLLIFYFCNCSTMSSVNQSSGTPNPEEVTSPESTEENKNVVSSDEAQATHAVALPIVTQLSLPEGVGTSSEETASNPRVDEIVAEVSSSRAVADQISSLVERVGELLDDLKGAQSLFTSFQSELKNCLPAWKSSTRRLETRGAGDNADIARLELFRSDYEAVLGHANQFHGKAHLILSKLTDVHHKLQGLSREDLSLAFDNNDRVLEHLGSLGLDVDAEGNWSLSCERGIPRLVLTADSMLVQIKKVNLPTVEELRTLQGTTESSSDPRVEESLSCCERLLNELRRLWANFVGFISSCYDNIVFVLMWIVRRINLLPGLGCLPFHNPDASQEDQRSSSGERSTRRERLSRRSDLSEEEMIVRAEGESIHPESPHGDGRNQPSRGDKQDSDSEEETEL

SEQ ID NO: 502 - protein, 572 aa, Chlamydia pneumoniae
  CPn0500
QPHSMKTSQLFYKTSKNANKSAAVLSNELLEKAGYLFKVSKGVYTYTPLLWRVVSKMMNIIREELNAIGGQELLLPLLHNAELWQHTGRWEAFTSEGLLYTLKDREGKSHCLAPTHEEVICSFVAQWLSSKRQLPLHLYQIATKFRDEIRPRFGLIRSRELLMEDSYTFSDSPEQMNEQYEKLRSAYSKIFDRLGLAYVIVTADGGKIGKGKSEEFQVLCSLGEDTICVSGSYGANIEAAVSIPPQHAYDREFLPVEEVATPGITTIEALANFFSIPLHKILKTLVVKLSYSNEEKFIAIGMRGDRQVNLVKVASKLNADDIALASDEEIERVLGTEKGFIGPLNCPIDFFADETTSPMTNFVCAGNAKDKHYVNVNWDRDLLPPQYGDFLLAEEGDTCPENPGHPYRIYQGIEVAHIFNLGTRYTDSFEVNFQDEHGQTQQCWMGTYGIGVGRTLAACVEQLADDRGIVWPKALAPFSITIAFNGGDTVSQELAETIYHELQSQGYEPLLDDRDERLGFKLKDSDLIGIPYKLILGKSYQSSGIFEIESRSGEKYTVSPEAFPTWCQNHLA

SEQ ID NO: 503 - protein, 409 aa, Chlamydia pneumoniae
  CPn0501
ILLTFSGSFPIMLSVTIVLVGLEMARSKVSKRDSKILDILFATTELYLKTGQPVGSKTLKESFCSDLSTATIRNYFAELEAEGFLKKNHTSGGRIPTDLALRHYVDHQEECPEAEISAPIFDKISQLPSESRNIIKDLQKATELLGEILDLPTFFSSPRFENDSVTNIQITQVDKQRAVTILSTEFGQIFTDTLWLPEACDTLSIKRIEKFLQNYIRKLPTNEELSKKEEHLSMSLYNEVVVRYLTRYCNFSEEDLYQTGMSKLLKYEAFKDPEVLALGLSLFENRRQMCELLNIGMHKGRATAFIGKELSDILGTSNPGCSVITIPYYMNRSPLGALGILGPINLPYKEALPLLKLFANKINETLTQSFYKFKLSFRRPLTSNCKLSNEPILRTEYSSIKLLPSKETL

SEQ ID NO: 504 - protein, 187 aa, Chlamydia pneumoniae
  CPn0502
GDVMTDTPPENEEQHESNVQNENEVEHLQQEIVTLKTELKEKNDKYLMALAESENSRKRLQKERQELMQYALENTLIDFLNPIESMEKALGFATQMSDDVKNWALGFNMILNQFKQIFEEKGIIEYSSIGQKFNPFLHEAVQTEETSEVPEGTILEEFAKGYKIGERPIRVAKVKVAKAPTPKENKE

SEQ ID NO: 505 - protein, 663 aa, Chlamydia pneumoniae
  CPn0503
VPNMSEHKKSSKIIGIDLGTTNSCVSVMEGGQAKVITSSEGTRTTPSIVAFKGNEKLVGIPAKRQAVTNPEKTLGSTKRFIGRKYSEVASEIQTVPYTVTSGSKGDAVFEVDGKQYTPEEIGAQILMKMKETAEAYLGETVTEAVITVPAYFNDSQRASTKDAGRIAGLDVKRIIPEPTAAALAYGIDKVGDKKIAVFDLGGGTFDISILEIGDGVFEVLSTNGDTLLGGDDFDEVIIKWMIEEFKKQEGIDLSKDNMALQRLKDAAEKAKIELSGVSSTEINQPFITMDAQGPKHLALTLTRAQFEKLAASLIERTKSPCIKALSDAKLSAKDIDDVLLVGGMSRMPAVQETVKELFGKEPNKGVNPDEVVAIGAAIQGGVLGGEVKDVLLLDVIPLSLGIETLGGVMTTLVERNTTIPTQKKQIFSTAADNQPAVTIVVLQGERPMAKDNKEIGRFDLTDIPPAPRGHPQIEVSFDIDANGIFHVSAKDVASGKEQKIRIEASSGLQEDEIQRMVRDAEINKEEDKKRREASDAKNEADSMIFRAEKAIKDYKEQIPETLVKEIEERIENVRNALKDDAPIEKIKEVTEDLSKHMQKIGESMQSQSASAAASSAANAKGGPNINTEDLKKHSFSTKPPSNNGSSEDHIEEADVEIIDNDDK

SEQ ID NO: 506 - protein, 699 aa, Chlamydia pneumoniae
  CPn0504
ATQFTSETTGFLVQCPKLTGGAQLLKKPKRKPGRRTYGKSLKIFIPGTLFVHARKGFGFVSPDNPEEYPFDIFVPARDLRGALDGDHVIVSVLPYPRDGQKLKGTISEVLARGKTTLVGTITSLVSPTSALAYTSMSGSQSLIPVELLPGRTYKIGDRILLSTPPWVDKPQEGASPALQMLEFIGHITNAKADFQAIQAEYNLAEEFPPEVIEEASLFSQKHITQVLHSRKDLRDLLCFTIDSSTARDFDDAISLTYDHNNNYILGVHIADVSHYVTPHSHLDKEAAKRCNSTYFPGKVIPMLPSALSDNLCSLKPNVDRLAVSVFMTFTKSGHLSDYQIFRSVIRSKYRMTYDEVDNIIEKKHSHPLSKILNEMATLSKKFSDIREERGCIRFVLPSVTMSLDNLQEPVALIENHQTFSHKLIEEFMLKANEVVAYHISHQGVSLPFRSHEPPNDENLLAFQELAKNMGFDITFTPTQEPDYQYLLQTTSAGHPLEQVLHSQFVRSMKTASYSTENKGHYGLKLDYYTHFTSPIRRYIDLIVHRLLFNPLSIDQTHLEIIVRACSTKERVSAKAENSFENLKKTRFINKFLQEQPKTTYHAYIITANHEGLSFVVTEFCHEGFIAAAELPKEYSLKKNALPESIPDKMKPGASIKVTIDSVNLLTQKIVWSIATTTEDKPKKIKKTPSKKKGTKKRAS

SEQ ID NO: 507 - protein, 212 aa, Chlamydia pneumoniae
  CPn0505
RKRLLRKKERKKEPRNVLQEHFFLSEDVITLAQQLLGHKLITTHEGLITSGYIVETEAYRGPDDKACHAYNYRKTQRNRAMYLKGGSAYLYRCYGMHHLLNVVTGPEDIPHAVLIRAILPDQGKELMIQRRQWRDKPPHLLTNGPGKVCQALGISLENNRQRLNTPALYISKEKISGTLTATARIGIDYAQEYRDVPWRFLLSPEDSGKVLS

SEQ ID NO: 508 - protein, 262 aa, Chlamydia pneumoniae
  CPn0506
CPMEISPIPRRFGKSFILNNLKLYSKETNAHFLISCRRIMKKYFITGLVILLPLAITIAIVTMIMNFLTQPFVGLASEFFEKFSFYTKHRALLKFVLQIILLFGLFFATVLLGFLTRIMIFKSLLSIYDKILHRIPIIKTVYKAAQQVMTTIFGSKSGSFKQVVMVPFPNANVQCIGLVAGDAPTVCCTGEKEDDPLVTVFIPTTPNPTSGFLTLFRKSDIVFLDMKIEDAFKYIISCGVLSTPMACPSSPLPDELHQDQGS

SEQ ID NO: 509 - protein, 75 aa, Chlamydia pneumoniae
  CPn0507
STPYPQFPLSGEIKKFNIELFMTRMSKQARRRAKSPKKRKPKYAIVHPAPAPRIVYKLHTNALSTSDSIFIPKIG

SEQ ID NO: 510 - protein, 56 aa, Chlamydia pneumoniae
  CPn0508
SRIMSRHRSYGKSVKGVTKRNVLKRFERVEVLRKLGRWNDSTAKKVTGLPKTPILK

SEQ ID NO: 511 - protein, 170 aa, Chlamydia pneumoniae
  CPn0509
NKFVFLYGNFIRVTQEKIKIHVSNEQTCIPIHLVSVEKLVLTLLEHLKVTTNEIFIYFLEDKALAELHDKVFADPSLTDTITLPIDAPGDPAYPHVLGEAFISPQAALRFLENTSPNQEDIYEEISRYLVHSILHMLGYDDTSSEEKRKMRVKENQILCMLRKKHALLTA

SEQ ID NO: 512 - protein, 390 aa, Chlamydia pneumoniae
  CPn0510
QLNMLHILLAIFCILLFLAFGLTQPSCHGSSKFLKTLNQRFFKDKGREYPPFPSAPTILATLLCILYGALGTKLYTLLPPKTAHKDLLFWPLYSLSALIAYGFLPPWISTKVPKETTAHLRFLASVFQLGLFPLQLLFYRRRPNQQVRSSTSFQSQLSEALSAFDNLIVREVMIPKVDIFALPEETTLQEALVLVSEEGYSRVPVYKKNLDNITGILLVKDLLLLYTSSHDLSQPISSVAKPPFYAPEIKKASSLLQEFRQKHRHLAIIVNEYGFTEGIATMEDIIEEIIGEIADEHDVQENTPYKKIGSSWIVDGRMNISDAEEYFNLKIDHENSYDTLGGHVFHKVGAVPQKGMRIHHENFDIEIITCTERNVGKLKITPRKRKFNIS

SEQ ID NO: 513 - protein, 116 aa, Chlamydia pneumoniae
  CPn0511
MSDIQKEEHGSTTIFHLHGKLDGISSPEVQENISQSLAAGSKNIILDCAHLDYMSSAGIRVLLQSYHQVGQHSGKIVLTTVPKTIEQTLYVTGFLSYFKIFNTVDEAIQTLNKDGD

SEQ ID NO: 514 - protein, 625 aa, Chlamydia pneumoniae
  CPn0512
SLPLTMRRSVCYVNPSIARAGQISTWKFLYSLATPLPAGTKCKFDLAGSGKPTDWEAPATDLSQTRNVIYAEMPEGEIIEATAIPVKDNPVPQFEFTLPYELQVGETLTIVMGASPNHPQVDDAGNGAQLFAQRRKPFYLYIDPTGEGNYDEPDVFSMDIRGNVLKKIEIFTPSYVVKNKRFDITVRFEDEFGNLTNFSPEETRIELSYEHLRENLNWQLFIPETGFVILPNLYFNEPGIYRIQLKNLSTQEIFISAPIKCFADSAPNLMWGLLHGESERVDSEENIETCMRYFRDDRALNFYASSSFENQENLSPDIWKLINQTVSDFNEEDRFITLSGFQYSGEPHLEGVRHILHTKETKSHSKHKEYKHIPLAKLYKSTVNHDMISIPSFTASKEHGFDFENFYPEFERVVEIYNAWGSSETTAALNNPFPIQGKDSEDPRGTVIEGLKKNLRFGFVAGGLDDRGIYKDYFDSPQVQYSPGLTAIICNKYTRESLVEALFARHCYATTGPRIVLSFNITSAPMGSELSTGSKPGLNVNRHISGHVAGTALLKTVEIIRNGEVLHTFFPDSNNLDYEYDDMVPLSSVTLKDPNGKAPFVFYYLRVTQADNAMAWSSPIWVDLN

SEQ ID NO: 515 - protein, 413 aa, Chlamydia pneumoniae
  CPn0513
VPICLAGPSLKGVKNQIAAKKKHVTKQSTVLQNLERIVHQSVHQMTTCLPQPPKTSPLYSIFEKLDAQERLSSEDALHLLLLTNKEDQRTLWNFADQVRKQRVGDTVYYSSTLYLYPTNFCDFSCKFCSFYAKPGDPKGWLYSPDDLLQQIQNIKTPITEVHIVGGCFPSCNLQYYSDLFTKIKEYDPQIHIKALTAIEYAYLSDLDNLSIRDVLLTLKDAGLDSIPGGGAEILVDKIRNFLAPKRLSSSDFLNIHKMAHQLGIHSNITMLCYHKEGPEDLVTHMVKVRDLQDETQGFKNFILLKFAQENNVLGKRLRKSGQGHAIPLKSLMAVARIFLDNFSNMKALWNYLGIEAALDLLSCGANDLSSTHMGEKVFQMASSKEPIKMDAEGMAALITQQGRTPCLTNSSHV

SEQ ID NO: 516 - protein, 277 aa, Chlamydia pneumoniae
  CPn0514
GNGGPHHTTRENAMSNQLQPCISLGCVSYINSFPLSLQLIKRNDIRCVLAPPADLLNLLIEGKLDVALTSSLGAISHNLGYVPGFGIAANQRILSVNLYAAPTFFNSPQPRIAATLESRSSIGLLKVLCRHLWRIPTPHILRFITTKVLRQTPENYDGLLLIGDAALQHPVLPGFVTYDLASGWYDLTKLPFVFALLLHSTSWKEHPLPNLAMEEALQQFESSPEEVLKEAHQHTGLPPSLLQEYYALCQYRLGEEHYESFEKFREYYGTLYQQARL

SEQ ID NO: 517 - protein, 244 aa, Chlamydia pneumoniae
  CPn0515
EKNTTKALKNSGNIMEPSTNKPDCKKIFDSIASKYDRTNTILSLGMHHFWNRSLIQILGSGYSLLDLCAGTGKVAKRYIAAHPQASVTLVDFSSAMLDIAKQHLPQGSCSFIHSDINQLPLENHSYPLAAMAYGLRNLSDPHKALQEISRVLMPSGKLGILELTPPKKTHPTYSAHKLYLRAVVPWIGKSVSKDPDAYSYLSKSIQQLPKDHDLEDLFSKSGFYIAKKKKLFLGAATIWLLEKQ

SEQ ID NO: 518 - protein, 550 aa, Chlamydia pneumoniae
  CPn0516
RISISFRVSWFVKIILAVLGRAIAKAYYVCMVARGLCDFPTLVPNERLPIGPFFVPQHTSGAKGKEFAKRNFSIISGLDDILKLCILQRRPFALQWDNLSVKSDYEEAGPAIGIRSLEPQVSQISPAHGRLCSTLVQWAPILGSEEQLVWLEETMKRLKFPKSLGSKDAVIVDSEMVPVNANPTQEIPAASETVESSPVAPGNTTDTMPAASGTTDTTSGVSEAAAAEAAVDSTPGTEEEPSFSLRYALVVQNVPYPEPPKEPEVMFTDEEKSLILEATRARRMELDLYNGYLADYELSKDEIQKHVPDLPENWRTNWRWSERLYKFFFKTKKEGLEEIFLNKELGNMILARGLAATQSQARIKVFNSLVAWLLQSFNVGRSCTAKPLPTSKLDLFKSEFESKPKNNILTEFLVASDEEILFKGLRVLEPGIEGWYDHPDQAGEIRSVLEGLVQAGRISGYWENQPFGRFVLRGVGERRTELVELLESLVASGEIMQFFESSDEEGAFIIDNEPSKTAMLKQRFKSCVRTKLVGSFADESLPRGRFTILV

SEQ ID NO: 519 - protein, 281 aa, Chlamydia pneumoniae
  CPn0517
FIMSSLLSCGRIEPTRVTCSLKTYLEDTSQNQLSTRLVRASVIFLCALLIILVCVALSSLIPSIMALATSFTVMGLILFVMSLLGDVAIISYLTYSTVTSYRQNKRAFEIHKPARSVYYEGVRHWDLGRSSLGTGEIPIVRTLFSPFQNHGLNHALAAKIFLFMEHFSPEPPNEPLVDWACLIRDFRPHVSSLCFVIEKQGSSLRTKEGNTICEAFRSDYDAHFAMVDCYRLIHSKLIIEKMGLKNIDIIPSVMVREDYPSRPGEGYREGLLRMYGGKGAL

SEQ ID NO: 520 - protein, 325 aa, Chlamydia pneumoniae
  CPn0518
FMMTYPVPQNPLLLRILRLMDAFSKSDDERDFYLDRVEGFILYIDLDKDQEDLNKIYQELEENAERYCLIPKLTFYEVKKIMETFINEKIYDIDTKEKFLEILQSKNAREQFLEFIYDHEAELEKWQQFYVERSRIRIIEWLRNNKFHFVFEEDLDFTKNVLEQLKIHLFDAKVGKEITQARQLLSNKAKIYYSNEALNPRPKRGRPPKQSAKVETETTISSDIYTKVPQAARRFLFLPEITSPSSITFSEKFDTEEEFLANLRGSTRVEDQLNLTNLSERFASLKELSAKLGYDSLSTGDFFGDDDEKVVTKTKGSKRGRKKSS

SEQ ID NO: 521 - protein, 268 aa, Chlamydia pneumoniae
  CPn0519
QPTKLRILVYWMAFYSPSTISKYFIYSGAGNRFLLGETLPEVEDVRFLCQETRVDGFLYLKPSSCADAQLIIFNSDGSRPTMCGNGLRCAIAHLASQKGKSDISVSTDSGLYSGYFYSWDRVLVDMTLADWRASVHRLESRPDPLPKEVVCIHTGVPHAVVILPEISTLDLSILGPFLRYHQTFSPDGVNVNFVQILGHCQLRVRTYERGVEGETAACGTGALASALVVSNSYGWKESIQIHTWGGELMTVSQNRGRVYLQGSVTRDL

SEQ ID NO: 522 - protein, 196 aa, Chlamydia pneumoniae
  CPn0520
ERHYFMADGEVHKLRDIIEKELLEARRVFFSEPVTEKSASDAIKKLWYLELKDPGKPIVFVINSPGGSVDAGFAVWDQIKMLTSPVTTVVTGLAASMGSVLSLCAAPGRRFATPHSRIMIHQPSIGGPITGQATDLDIHAREILKTKARIIDVYVEATNQPRDIIEKAIDRDMWMTANEAKDFGLLDGILFSFNDL

SEQ ID NO: 523 - protein, 521 aa, Chlamydia pneumoniae
  CPn0521
KSLLKVFEKFKKFAIVEIFTKVVAVVSLLHKFLENASGKKGQSLASTAYLAALDHLLNAFPSIGERIIDELKSQRSHLKMIASENYSSLSVQLAMGNLLTDKYCEGSPFKRFYSCCENVDAIEWECVETAKELFAADCACVQPHSGADANLLAVMAILTHKVQGPAVSKLGYKTVNELTEEEYTLLKAEMSSCVCLGPSLNSGGHLTHGNVRLNVMSKLMRCFPYDVNPDTECFDYAEISRLAKEYKPKVLIAGYSSYSRRLNFAVLKQIAEDCGSVLWVDMAHFAGLVAGGVFVDEENPIPYADIVTTTTHKTLRGPRGGLVLATREYESTLNKACPLMMGGPLPHVIAAKTVALKEALSVDFKKYAHQVVNNARRLAERFLSHGLRLLTGGTDNHMMVIDLGSLGISGKIAEDILSSVGIAVNRNSLPSDAIGKWDTSGIRLGTPALTTLGMGIDEMEEVADIIVKVLRNIRLSCHVEGSSKKNKGELPEAIAQEARDRVRNLLLRFPLYPEIDLEALV

SEQ ID NO: 524 - protein, 277 aa, Chlamydia pneumoniae
  CPn0522
REPLSPEKTSLAFKVKNVNQRMIKKNQGKKKNYFQYIPLKVQKLRQPSFYPKRLMTLYLGLNQKTARKYQAHYLPILTLFPYAKSTPQNKRALQFLPQATHVILTSPSSTHLFLSRMTSLLSKATLKTKTYLCIGESTKERLLSFLGQVKYVVATQEIAEGIFPLLQALPSSARILYPHSSLARPVIREFLYNRFTFFSYPHYTVKPRKLKKNILSKYKKIIFTSPSTVRAFAKIFPRFPEKTYWCQGRMTLQEFQKFSSQKQVSLLETLGKSRTSP

SEQ ID NO: 525 - protein, 111 aa, Chlamydia pneumoniae
  CPn0523
FMASSATPGFDGTAPSLFPPATRPRYNFKLALFVTIAIALVWIALIATTIAIGLCIHPLCSFIFLTAIPLYFISRYICSHYARNVYIALDVVPDHSKLQDMRSHSPIFSDR

SEQ ID NO: 526 - protein, 367 aa, Chlamydia pneumoniae
  CPn0524
KVFYKKNVMSGPSRTESSQVSVLSYVPRDKEIAPKKQFTIAKISTLAILASLALGALVAGISLTIVLGNPVFLALLITTALFSVVTFLVYHQMTSKVSSNWQKVLEQNFKPLGKAWQEKNVDCYSNEMQFYNNHLNPKFKVAIQTDASQPFQPTFLTGLRVIEKNQSTGIIFNPVGPTNLIDNTATNLSTILYSTLKDKSVWDTCKQREGGPAKGEDPFSPTEVRVVKLPNEALDQTFNLNLSSAEKKSILPTFLGHVCGPKSEELPNQQEYYRQALLAYENCLKAAIESHAAIVALPLFTSVYEVPPEEILPKEGTFYWDNQTQAFCKRALLDAIQNTALRYPQRSLLVILQDPFNTIESQSRSEE

SEQ ID NO: 527 - protein, 258 aa, Chlamydia pneumoniae
  CPn0525
GIIFMHDALLSILAIQELDIKMIRLMRVKKEHQKELAKVQSLKSDIRRKVQEKELEMENLKTQIRDGENRIQEISEQINKLENQQAAVKKMDEFNALTQEMTTANKERRSLEHQLSDLMDKQAGGEDLIVSLKESLASTENSSSVIEKEIFESIKKINEEGKALLEQRTELKHATNPELLSIYERLLNNKKDRVVVPIENRVCSGCHIVLTPQHENLVRKKDRLIFCEHCSRILYWQESQVNAQENSTAKRRRRRAAV

SEQ ID NO: 528 - protein, 354 aa, Chlamydia pneumoniae
  CPn0526
VFNLIEKSFGVCYDGLKCSQSKENRMPSPMISTDVCQDILGKQKEAVDFFFQAFQPKEAMQLAEKILGHSGWVFFSGVGKSGCVARKLVATLQSLSERALFFSPVDLLHGDLGLVSPGDIVCLFSKSGETQELLDTVPHLKSRRAILVAITSMPYSNLAALSDLVVILPSVAELDPFNLIPTNSTTCQMIFGDFLAMLLFHSRGVSLSTYGKNHPSGQVGMKANGKVKDFMFPKTEVPFCHLGDKVSFSLEVFSAYGCGCVCIVDPQFRLMGIFTDGDLRRSLASYGGEVLSLSLEKVMTANPRCITEDSDIAIALQLMESSSPVAVLPVLDNEENRHVTGLLHMHTLAKAGLL

SEQ ID NO: 529 - protein, 395 aa, Chlamydia pneumoniae
  CPn0527
RYMIFEFRFPKIGETSSGGSIVRWLKNLGDHVARDEPLIEVSTDKIATELPSPKAGRLVRFCVNEGDEVASGDVLGLIELEEISEADDESTSCPPTSCETKSEAGSSSSSVWFSPAVLSLAQREGIGLDNLQKIAGTGKGGRVTRQDLEAYISESQQVSIPEIFQGEVNRIPMSPLRRAIASSLSKSSDEVPHASLVVDVDVTDLMNLISGERQRFLDTHGVKLTITSFIVQCLAQTLRQFPLLNGSLDGTTIVMKKSVNVGVAVNLNKEGVVVPVIHNCQDRGLVSIAKALADLSSRARLNKLDPSEVQDGSVTVTNFGMTGALIGMPIIRYPEVAILGIGTIQKRVVVRDDDSLAIRKMVYVTLTFDHRVLDGIYGSEFLTSLKNRLESVTMG

SEQ ID NO: 530 - protein, 415 aa, Chlamydia pneumoniae
  CPn0528
LMKLWMKIFIGLFVGVTLGLVLEDKAIFFKPIGDIFLNLLSMVVYPLVFCSMVLGIASISDMKKLGRIGIKSVGLYLGTTALAIVIGLCFAWIFSPGNGCDFAQAQSMDSAVTVIDSNKTAAYFLSIIAQVFPSNPVRSFAEGNILQIIIFAIFLGIALRLSGERGRPVERFIDGFSEIMLRMVNMIMSFAPYGVGASMAWISGNHGLGVLWQLGKFIIAYYLACLFHATLVFGGLVRFGCKMSFSKFLSSMMDAISCAVSTASSSATLPVTMRCVSKNLGVSAEVSGFVLPLGATVNMNGTAIFQGMAAVFIAQAYNCPLSLSSLLLLVVTATFSAVGSAGVPGGGMITLGSVLASVGLPIQGIAILAGIDRLRDIVGTPMNILGDAVVATYVASGEGELSPYESIKQESVETT

SEQ ID NO: 531 - protein, 378 aa, Chlamydia pneumoniae
  CPn0529
FSCKEIRAFKRGTMKKRFPSTLFLFYRRVTIAISLEGILGWGWLGSLLSKVFAFLVACWNRFSWSTPYRARSTVISVGNIVVGGAGKTPTVLWLAEALRLRGYSCGVLSRGYKSQSSRQKKLTVVDSKVHSASYVGDEPLLMAEKLPEGSVWVHKDRRISAARAAEKFGILLLDDGLQYRKLHKDVEIAVVNGQDPLGGRAFFPKGRLRDFPLRLKTVDAIIVNGGGKEAGTVVKRVSNAPQIFVKPTIASVVWTHNGERIPKEALRELRVGVFCGLGFPQGFLNMLREEGIHILGKYLLPDHAAITKKELNYFCQQMAMRQGQGLLCTEKDSVKLPRLSGEVSLLPIAKVEMRLSVNQDDTLSLLNMIEQIHKNRGN

SEQ ID NO: 532 - protein, 288 aa, Chlamydia pneumoniae
  CPn0530
SVVLWGKFLWRRCGSLAFWEFCSMDCIGKHNPLVKEALALKRSRCRKSSWFLVEGAREIQKALRTGYLCQHVFCSTHLSEKEKEFLYELKRNSTKILYCLDSTLAQLSFKEHHDSFVAVIQKRVWNKEDFLIQRKNAQPFYLIIEQVEKPGNVGAILRIADGAGVDGVILCNPIVDLYNPNVVRSSLGAVFSLPILSISREEGKELFKQEGWTVFVTSPRAETMYFSKNYLGPTALVFGSEKDGLTEDWFSEDFSEIALPMLGESDSLNLATSVAAVAYEVVRQRWVN

SEQ ID NO: 533 - protein, 318 aa, Chlamydia pneumoniae
  CPn0531
DSSKDDFRKEKGRRKSQYRDRYVNKDTGRHSKTYFSLIRERLVMDYKLLDSGDGNKLECFGPVTLIRPSSIAVWPKSRPELWSQAQLQYVREGERGAWKNFKRLPEEWEVAFSDVRCLLKRTPFGHLGVFPEHMGFWPALKQAIEKHKERQVLNLFAYTGAGSIFAAKCGARVTHVDASQAAVRWAQRNVEKNAFPERRIFWVIEDVISFLKKEIRRNKKYQVILLDPPSYGRGPDGEVFKIDKDLFPLLSLCSKLLADDASYFLLTSHTPGHTPEFLRAIARRSVPTLVSEAWSCGESFCGEGVGALPSGSFVQWIA

SEQ ID NO: 534 - protein, 214 aa, Chlamydia pneumoniae
  CPn0532
ESFCCKDSVVKWGGMFSGIIQELGEVCFFEAQGNGLSLGIKSTPLFVTPLVTGDSVAVDGVCLTLTSCNESKIFFDVIPETLACTTLGEKRCSDQVNLEAALKMGDSIGGHLLSGHVFGTAEIFLIKENRYYFRGSKELSQYLFEKGFIAIDGISLTLVSVDSDTFSVGLIPETLQRTTLGKKREGERVNIEIDMSTKIQVDTVKRILASSGKD

SEQ ID NO: 535 - protein, 156 aa, Chlamydia pneumoniae
  CPn0533
EVAPMQCPFCNHGELKVIDSRNAPEANAIKRRRECLKCSQRFTTFETVELTLQVLKRDGRYENFQESKLIHGLNAASSHTRIGQDQVHAIASNVKSELLGKQNREISTKEIGELVMKYLKKADMIAYIRFACVYRRFKDVGELMEVLLSATPDMEK

SEQ ID NO: 536 - protein, 132 aa, Chlamydia pneumoniae
  CPn0534
LNFIRSKVVPLSDDEIEQFKKRLLEMKAKLSHTLEGNAQEVKKPNEATGYSQHQADQGTDTFDRTISLEVTTKEYELLRQINRALEKINESSYGICDVSGEEIPLARLIAIPYATMTVKAQEQFEKGLLSGN

SEQ ID NO: 537 - protein, 178 aa, Chlamydia pneumoniae
  CPn0535
KRTPIWKLSSMATRFRSTLLVITLFVLIDWVTKLVVLLQYKDLQILTHPTLYTHSWGRFSFSIAPVFNEGAAFGLFSNYKYFLFLLRIFVILGLLAYLFFKKKSIQSTTQTALVLLCAGAIGNVGDIIFYGHIVDFISFNYKQWAFPTFNVADVLISLGTLLLVYKFYFPTKQTEKKR

SEQ ID NO: 538 - protein, 464 aa, Chlamydia pneumoniae
  CPn0536
YRSLQEKLRYFFKTVMNRLLSLLSVFDDFFWSYVAFILIIVLGVSFSWKSRFFQFTKFSQFCKLFRYYSQNPQERETKQGVHPLKVFFASAGGNIGIGNVVGIVTAACIGGPGALFWVWIAGIFGSIVKYSEVYLGIKFRKLDRDGVYQGGPMYFLIKAFKTPVVSVIVAILLCIYGVEIYQFSVITDSLAHCWNLPKVYPMLGLLFLVFYAIRGGLQRIGKICSIVLPFFMLLYCALSLYILVKEFHTLPHLLSTVFSSAFKGQSALGGFAGCTVATTIHQGISRAAYSGDIGIGFDSIIQSESSAKDPSTQAQLSIVGIAIDNLICTLSLLMVLASGSWSLGLENASQVVEHTLASYFPMVKFFLPTFFFVTGYTTIISYFLVGKKCAKFLYGNTGAKIYTLYGLLILPLFCFLSQNTALLIMSVSGALLLCFNLLGVFILRKEVIFPARAASLTETSLSTE

SEQ ID NO: 539 - protein, 125 aa, Chlamydia pneumoniae
  CPn0537
LIFLLFMDNYLLGSLIFCCVLLSIGMCTIFVMTICFLRQLNKILKNIHRVTTILNFEAKILAPLMLGKKLLCGWLKKRKNRGSLSEDIDELLDEKKQRSWKKNLDQGIKWCAALVLIWKVFRNKD

SEQ ID NO: 540 - protein, 128 aa, Chlamydia pneumoniae
  CPn0538
TKELNGAQHWSSFGKCFVIKIKTLRDIVMFRNNHKPKKTKCKRFRWLRGVLFGGFIATLLTCLFTPKSGVQLRKKILKVKNSGAKKSRVFFKNSKQHTKSFVKQAKLLAKNISHELQDFKKGILDDKD

SEQ ID NO: 541 - protein, 956 aa, Chlamydia pneumoniae
  CPn0539
GYNLLGLRHMKQMRLWGFLFLSSFCQVSYLRANDVLLPLSGIHSGEDLELFTLRSSSPTKTTYSLRKDFIVCDFAGNSIHKPGAAFLNLKGDLFFINSTPLAALTFKNIHLGARGAGLFSESNVTFKGLHSLVLENNESWGGVLTTSGDLSFINNTSVLCQNNISYGPGGALLLQGRKSKALFFRDNRGTILFLKNKAVNQDESHPGYGGAVSSISPGSPITFADNQEILFQENEGELGGAIYNDQGAITFENNFQTTSFFSNKASFGGAVYSRYCNLYSQWGDTLFTKNAAAKVGGAIHADYVHIRDCKGSIVFEENSATAGGAIAVNAVCDINAQGPVRFINNSALGLNGGAIYMQATGSILRLHANQGDIEFCGNKVRSQFHSHINSTSNFTNNAITIQGAPREFSLSANEGHRICFYDPIISATENYNSLYINHQRLLEAGGAVIFSGARLSPEHKKENKNKTSIINQPVRLCSGVLSIEGGAILAVRSFYQEGGLLALGPGSKLTTQGKNSEKDKIVITNLGFNLENLDSSDPAEIRATEKASIEISGVPRVYGHTESFYENHEYASKPYTTSIILSAKKLVTAPSRPEKDIQNLIIAESEYMGYGYQGSWEFSWSPNDTKEKKTIIASWTPTGEFSLDPKRRGSFIPTTLWSTFSGLNIASNIVNNNYLNNSEVIPLQHLCVFGGPVYQIMEQNPKQSSNNLLVQHAGHNVGARIPFSFNTILSAALTQLFSSSSQQNVADKSHAQILIGTVSLNKSWQALSLRSSFSYTEDSQVMKHVFPYKGTSRGSWRNYGWSGSVGMSYAYPKGIRYLKMTPFVDLQYTKLVQNPFVETGYDPRYFSSSEMTNLSLPIGIALEMRFIGSRSSLFLQVSTSYIKDLRRVNPQSSASLVLNHYTWDIQGVPLGKEALNITLNSTIKYKIVTAYMGISSTQREGSNLSANAHAGLSLSF

SEQ ID NO: 542 - protein, 1744 aa, Chlamydia pneumoniae
  CPn0540
FIHLIYLSLIEFVNISDRFSSMKWLPATAVFAAVLPALTAFGDPASVEISTSHTGSGDPTSDAALTGFTQSSTETDGTTYTIVGDITFSTFTNIPVPVVTPDANDSSSNSSKGGSSSSGATSLIRSSNLHSDFDFTKDSVLDLYHLFFPSASNTLNPALLSSSSSGGSSSSSSSSSSGSASAVVAADPKGGAAFYSNEANGTLTFTTDSGNPGSLTLQNLKMTGDGAAIYSKGPLVFTGLKNLTFTGNESQKSGGAAYTEGALTTQAIVEAVTFTGNTSAGQGGAIYVKEATLFNALDSLKFEKNTSGQAGGGIYTESTLTISNITKSIEFISNKASVPAPAPEPTSPAPSSLINSTTIDTSTLQTRAASATPAVAPVAAVTPTPISTQETAGNGGAIYAKQGISISTFKDLTFKSNSASVDATLTVDSSTIGESGGAIFAADSIQIQQCTGTTLFSGNTANKSGGGIYAVGQVTLEDIANLKMTNNTCKGEGGAIYTKKALTINNGAILTTFSGNTSTDNGGAIFAVGGITLSDLVEVRFSKNKTGNYSAPITKAASNTAPVVSSSTTAASPAVPAAAAAPVTNAAKGGALYSTEGLTVSGITSILSFENNECQNQGGGAYVTKTFQCSDSHRLQFTSNKAADEGGGLYCGDDVTLTNLTGKTLFQENSSEKHGGGLSLASGKSLTMTSLESFCLNANTAKENGGGANVPENIVLTFTYTPTPNEPAPVQQPVYGEALVTGNTATKSGGGIYTKNAAFSNLSSVTFDQNTSSENGGALLTQKAADKTDCSFTYITNVNITNNTATGNGGGIAGGKAHFDRIDNLTVQSNQAKKGGGVYLEDALILEKVITGSVSQNTATESGGGIYAKDIQLQALPGSFTITDNKVETSLTTSTNLYGGGIYSSGAVTLTNISGTFGITGNSVINTATSQDADIQGGGIYATTSLSINQCNTPILFSNNSAATKKTSTTKQIAGGAIFSAAVTIENNSQPIIFLNNSAKSEATTAATAGNKDSCGGAIAANSVTLTNNPEITFKGNYAETGGAIGCIDLTNGSPPRKVSIADNGSVLFQDNSALNRGGAIYGETIDISRTGATFIGNSSKHDGSAICCSTALTLAPNSQLIFENNKVTETTATTKASINNLGAAIYGNNETSDVTISLSAENGSIFFKNNLCTATNKYCSIAGNVKFTAIEASAGKAISFYDAVNVSTKETNAQELKLNEKATSTGTILFSGELHENKSYIPQKVTFAHGNLILGKNAELSVVSFTQSPGTTITMGPGSVLSNHSKEAGGIAINNVIIDFSEIVPTKDNATVAPPTLKLVSRTNADSKDKIDITGTVTLLDPNGNLYQNSYLGEDRDITLFNIDNSASGAVTATNVTLQGNLGAKKGYLGTWNLDPNSSGSKIILKWTFDKYLRWPYIPRDNHFYINSIWGAQNSLVTVKQGILGNMLNNARFEDPAFNNFWASAIGSFLRKEVSRNSDSFTYHGRGYTAAVDAKPRQEFILGAAFSQVFGHAESEYHLDNYKHKGSGHSTQASLYAGNIFYFPAIRSRPILFQGVATYGYMQHDTTTYYPSIEEKNMANWDSIAWLFDLRFSVDLKEPQPHSTARLTFYTEAEYTRIRQEKFTELDYDPRSFSACSYGNLAIPTGFSVDGALAWREIILYNKVSAAYLPVILRNNPKATYEVLSTKEKGNVVNVLPTRNAARAEVSSQIYLGSYWTLYGTYTIDASMNTLVQMANGGIRFVF

SEQ ID NO: 543 - protein, 289 aa, Chlamydia pneumoniae
  CPn0541
NNRSSYQTAFVMHKVIVFIFLTLYSLKSYGNDVIDKPHVLVSIAPYKFLVEQIAEETCFVYAIVTNHYDPHTYELPPQQIKELRQGDLWFRIGEAFEKTCERNLTCQQVDLSQNVSLIQGKPCCNQHTTNYDTHTWLSPKNLKVQVETIVTTLSKKYPQHATLYQSNGEKLLLALDQLNEEILTITSKAKQRHILVSHGAFGYFCRDYNFSQHTIEKSSHVEPSPKDVARVFRDIEQYKISSVILLEYSGRRSSAMLADRFHMHTVNLDPYAENVLVNLKTIATTFSSL

SEQ ID NO: 544 - protein, 246 aa, Chlamydia pneumoniae
  CPn0542
FMTIRILAEGLAFRYGSKGPNIIHDVSFSVYDGDFIGIIGPNGGGKSTLTMLILGLLTPTFGSLKTFPSHSAGKQTHSMIGWVPQHFSYDPCFPISVKDVVLSGRLSQLSWHGKYKKKDFEAVDHALDLVGLSDHHHHCFAHLSGGQIQRVLLARALASYPEILILDEPTTNIDPDNQQRILSILKKLNRTCTILMVTHDLHHTTNYFNKVFYMNKTLTSLADTSTLTDQFCCHPYKNQEFSCSPH

SEQ ID NO: 545 - protein, 298 aa, Chlamydia pneumoniae
  CPn0543
KSGIFMLSSLIRDSFPLLILLPTFLAALGASVAGGVMGTYIVVKRIVSISGSISHAILGGIGLTLWIQYKLHLSFFPMYGAIVGAIFLALCIGKIHLKYQEREDSLIAMIWSVGMAIGIIFISRLPTFNGELINFLFGNILWVTPSDLYSLGIFDLLVLGIVVLCHTRFLALCFDERYTALNHCSVQLWYFLLLVLTAITIVMLIYVMGTILMLSMLVLPVAIACRFSYKMTRIMFISVLLNILCSFSGICIAYCLDFPVGPTISLLMGLGYTASLCVKKRYNPSTPSPVSPEINTNV

SEQ ID NO: 546 - protein, 358 aa, Chlamydia pneumoniae
  CPn0544
KSSVFCSGIKSSFFCLKKDKNVIMFVDQITLELRAGKGGNGVVAWRKEKYLPKGGPYGGNGGNGGSVIIEATTSVYSFEAYRNIRFLKAPDGQSGATNNRTGRSGKDLIVSVPTGTLLRDAETGEILHDFTVDGERLLVSQGGKGGKGNTFFKTSVNRAPTKATPGKPGEIRQVELELKLIADIGLVGFPNAGKSTLFNTLAHTEVKVGAYPFTTLAPSLGLVLCKDRLYQKPWIIADIPGIIEGAHQNKGLGLDFLRHIERTLLLLFVIDVSKRERNSPEEDLETLIHELHSHQPDFEKKDMLVALNKIDDLLPDEQEECLQSFQKRFPSYTFVLISGLTGEGVDGLYRFFTQRLAV

SEQ ID NO: 547 - protein, 92 aa, Chlamydia pneumoniae
  CPn0545
TEAREFRVMAHKKGQGASRNGRDSKSKRLGVKVGAGQKVSTGSILVRQRGTRWNPAQNVGRGRDDTLFALVDGIVVMKKTNRTYISVVPEQL

SEQ ID NO: 548 - protein, 124 aa, Chlamydia pneumoniae
  CPn0546
LSKQRLTLSIERFIRKKLMEPYAVIQTGSKQYQVRSGDVIDVELLGEVASDKEVIFQDVLFVFDGTKASLGSPTIANAQVKAEYLSHVKGEKVVAYKYKKRKNYHRKHGHRQKYLRVKIREILI

SEQ ID NO: 549 - protein, 200 aa, Chlamydia pneumoniae
  CPn0547
CVNFRNFVVSSVKEILKKNIYQVVMDRDNEVPLPKPKWIYRTGIGQDSHRFLPESSTKPCILGGIIFDHCPGFQANSDGDIIFHAICNAISSVTNKIILGKVADELLQTRGITDSGIYLEEALKSLKPNQKISHVAITIEGSRPKFLCKLSALRQNIAQVMNLTPTDIGITATSGEGLSDFGCGDGVQCFCVLTVMEYCD

SEQ ID NO: 550 - protein, 348 aa, Chlamydia pneumoniae
  CPn0548
KMYLQEKFKAQQVPLVLRELLSCSDSINDSDPIYRMVFDSNDTTISYKVGDALGVLPENSKEVSEHVLQLLGYSPTTLVNVKKTSEKVSAQKFIQGYVDLDKIPAKLNSFFPDKDPKITLYDAIQEYRPQIPIELFAESVFPLLPRFYSIASSPDLHPKSIELLVKHVSYPGKYQKRFGVCSSFLCSELQVNDSAYIFVQPTKHFTLSTQTEGKPLVMIGAGTGIAPYKAFLEERLFNKDPGNNLLFFGERKEKVNFYYREFWNHAEEEGKLKLFLAFSRERDQKVYVQDLLRIQKDEVRKAYEEGGFFFVCGRKVLGIEVKHALEEILGKDTLASLRKEHRYVVDVY

SEQ ID NO: 551 - protein, 136 aa, Chlamydia pneumoniae
  CPn0549
PQDVQHQPWNQHSLLRFLKKFKKRLLRSKGCMKQQKQKIRIRLKGFDQGQLDRSTADIVETAKRTGARVVGPIPLPTKREVYTVLRSPHVDKKSREQFEIRTHKRLVDILDPTGKTIDALKMLALPAGVDIKIKAA

SEQ ID NO: 552 - protein, 703 aa, Chlamydia pneumoniae
  CPn0550
LNYGENNKFMSNQEFDLSAIRNIGIMAHIDAGKTTTTERILFYAGRTHKIGEVHEGGATMDWMAQEQERGITITSAATTVFWLGAKINIIDTPGHVDFTIEVERSLRVLDGAVAVFDAVSGVEPQSETVWRQADKYGVPRIAFVNKMDRMGADYFAAVESMKEKLGANAFPVHCPIGSESQFVGMVDLISQKALYFLDDTLGAKWEEKEISEDLKERCAELRANLLEELATIDESNEAFMMKVLEDPDSITEDEIHQVMRKGVIENKINPVLCGTAFKNKGVQQLLNVIVKWLPSPLDRGNIRGINLKTDQEISLEPRRDGPLAALAFKIMTDPYVGRITFIRIYSGTLKKGSAILNSTKDKKERISRLLEMHANERTDRDEFTVGDIGACVGLKFSVTGDTLCDDNQEIVLERIEFPDPVIDMAIEPKSKGDREKLAQALSSLSEEDPTFRVSTNEETGQTIISGMGELHLDILRDRMIREFKVEANVGKPQVSYKETITVSGNSETKYVKQSGGRGQYAHVCLEIEPNEPGKGNEVVSKIVGGVIPKEYIPAVIKGIEEGLNTGVLAGYGLVDVKVSIVFGSYHEVDSSEMAFKICGSMAVKDACRKAKPVILEPIMKVAVITPEDHLGDVIGDLNRRRGKILGQESSRGMAQVNAEVPLSEMFGYTTSLRSLTSGRATSTMEPAFFAKVPQKIQEEIVKK

SEQ ID NO: 553 - protein, 159 aa, Chlamydia pneumoniae
  CPn0551
MYMSRRHSAEKRDIPGDPIYGSVILEKFINKVMMHGKKSVARKIVYSALERFGKKLNLENVLEGFGEALENAKPILEVRSRRVGGATYQVPVEVASERRNCLAMQWIIKHARSKPGKSMEVGLATELIDCFNKQGATIKKREDTHRMAEANKAFAHYKW

SEQ ID NO: 554 - protein, 160 aa, Chlamydia pneumoniae
  CPn0552
IQAGYVPSSSENKPLPTKRALLYISMLVVVRLKREEYMPTINQLIRKRRKSSLARKKSPALQKCPQKRGVCLQVKTKTPKKPNSALRKVAWVRLSNGQEVIAYIGGEGHNLQEHSIVLIQGGRVKDLPGVRYHIVRGTLDCAAVKNRKQSRSRYGAKRPK

SEQ ID NO: 555 - protein, 314 aa, Chlamydia pneumoniae
  CPn0553
GCMWRVVLRFLIIFILGRAVFPLRASESFSWETSTCLTVLGIPFIDIILTTNEDFVAQCGLQIGTISSTNNAKIKEIFLIYKEKFPEASISFKRKEPLNLSQSHLSDLGILCMRNGETYAEGMANKENGPALKQPKDLRLVLRCPNQPDTLLYSEKEAEKGIETNTCLCNQGYTLLDGQLILYGDSIEKFLKETKRKNNHTLVDLCDSQVVTTFLGRFWSLLNYVQVLFLSEDSAKILAGIPDLAQATQLLSHTVPLLFIYTNDSIHIIEQGKESSFTYNQDLTEPILGFLFGYINRGSMEYCFNCAQSSLGET

SEQ ID NO: 556 - protein, 112 aa, Chlamydia pneumoniae
  CPn0554
VFSYLLLCIILVYVRFMYEGKSRMASPTPGQLHLQQKVESKAYDYSRSLAMIATALLFFIVALILSGLSLLPQVFLPFSGAYFIIGSFLAFIALGILLINCVCDLKQYLTSS

SEQ ID NO: 557 - protein, 648 aa, Chlamydia pneumoniae
  CPn0555
MFVMKKLVRLCVVLLSLLPNVLFSSDLLREEGIKKMMDKLIEYHVDAQEVSTDILSRSLSSYIQSFDPHKSYLSNQEVAVFLQSPETKKRLLKNYKAGNFAIYRNINQLIHESILRARQWRNEWVKNPKELVLEASSYQISKQPMQWSKSLDEVKQRQRALLLSYLSLHLAGASSSRYEGKEEQLAALCLRQIENHENVYLGINDHGVAMDRDEEAYQFHIRVVKALAHSLDAHTAYFSKDEALAMRIQLEKGMCGIGVVLKEDIDGVVVREIIPGGPAAKSGDLQLGDIIYRVDGKDIEHLSFRGVLDCLRGGHGSTVVLDIHRGESDHTIALRREKILLEDRRVDVSYEPYGDGVIGKVTLHSFYEGENQVSSEQDLRRAIQGLKEKNLLGLVLDIRENTGGFLSQAIKVSGLFMTNGVVVVSRYADGTMKCYRTVSPKKFYDGPLAILVSKSSASAAEIVAQTLQDYGVALVVGDEQTYGKGTIQHQTITGDASQDDCFKVTVGKYYSPSGKSTQLQGVKSDILIPSLYAEDRLGERFLEHPLPADCCDNVLHDPLTDLDTQTRPWFQKYYLPNLQKQETLWREMLPQLTKNSEQRLSENSNFQAFLSQIKSSEKTDLSYGSNDLQLEESINILKDMILLQQCRK

SEQ ID NO: 558 - protein, 199 aa, Chlamydia pneumoniae
  CPn0556
ENGMSSNLHPVGGTGTGAAAPESVLNIVEEIAASGSVTAGLQAITSSPGMVNLLIGWAKTKFIQPIRESKLFQSRACQITLLVLGILLVVAGLACMFIFHSQLGANAFWLIIPAAIGLIKLLVTSLCFDEACTSEKLMVFQKWAGVLEDQLDDGILNNSNKIFGHVKTEGNTSRATTPVLNDGRGTPVLSPLVSKIARV

SEQ ID NO: 559 - protein, 559 aa, Chlamydia pneumoniae
  CPn0557
EIPMSKLIRRVVTVLALTSMASCFASGGIEAAVAESLITKIVASAETKPAPVPMTAKKVRLVRRNKQPVEQKSRGAFCDKEFYPCEEGRCQPVEAQQESCYGRLYSVKVNDDCNVEICQSVPEYATVGSPYPIEILAIGKKDCVDVVITQQLPCEAEFVSSDPETTPTSDGKLVWKIDRLGAGDKCKITVWVKPLKEGCCFTAATVCACPELRSYTKCGQPAICIKQEGPDCACLRCPVCYKIEVVNTGSAIARNVTVDNPVPDGYSHASGQRVLSFNLGDMRPGDKKVFTVEFCPQRRGQITNVATVTYCGGHKCSANVTTVVNEPCVQVNISGADWSYVCKPVEYSISVSNPGDLVLHDVVIQDTLPSGVTVLEAPGGEICCNKVVWRIKEMCPGETLQFKLVVKAQVPGRFTNQVAVTSESNCGTCTSCAETTTHWKGLAATHMCVLDTNDPICVGENTVYRICVTNRGSAEDTNVSLILKFSKELQPIASSGPTKGTISGNTVVFDALPKLGSKESVEFSVTLKGIAPGDARGEAILSSDTLTSPVSDTENTHVY

SEQ ID NO: 560 - protein, 92 aa, Chlamydia pneumoniae
  CPn0558
KLMKKAVLIAAMFCGVVSLSSCCRIVDCCFEDPCAPSSCNPCEVIRKKERSCGGNACGSYVPSCSNPCGSTECNSQSPQVKGCTSPDGRCKQ

SEQ ID NO: 561 - protein, 76 aa, Chlamydia pneumoniae
  CPn0559
QNNFVTLKNKNEGEMKLFYFCNIIFLTSLFSVSCTHTPPPRSYILAQGRTPLVNKAHSLEFFLARSVFNTCYNTNL

SEQ ID NO: 562 - protein, 523 aa, Chlamydia pneumoniae
  CPn0560
RNSRFQGMKSLWSKDKRIMNWENVRVRVAPSPTGDPHVGTAYMALFNEIFAKRFKGKMILRIEDTDRTRSRQDYEENIFSALRWCGIQWDEGPDVGGPYGPYRQSERTKIYQGYVETLLKTDCAYKCFATPQELAEMRAVASTLGYRGGYDRRYRYLSPEEVASREAAGQPYTIRLKVPLSGECVFEDYSKGRVVFPWADVDDQVLVKSDGFPTYHFANVIDDHLMGITHVLRGEEWLSSTPKHLLLYEAFGWEPPVFLHMPLLLNPDGTKLSKRKNPTSIFYYRDSGYVKEAFVNFLTLMGYSMEGDEEVYSLERIIETFNPRRIGKSGAVFDIQKLDWMNKHYLNHEGSPECLLKELQGWLLNDEFFLKILPLCQSRITTLAEFINLTSFFFSGLLEYRVEELLPQALSPEKAAILLYSYVKYLEKTDQWTKETCYLGSKWLAQAFNVHHKKAIIPLLYVAITGKKQGLPLFDSIEILGKPRARARLVYAEKLLGGVPKKLAATVDKFMQREDFEEATFDL

SEQ ID NO: 563 - protein, 179 aa, Chlamydia pneumoniae
  CPn0561
LMACEQHEGCYELEEREEIEDIKDSDTKWVSITQAAKLHNVTRQAIYVAIKQKKLKASKETRWEIDIKDLEEYKRNRYSRKKSLYQGELVFDNGKGCYSINQVAQILGIPVQKVYYATRTGTIRGERKGAAWVIHVSEIERYKNEYLSKQAAKKLKGAEPKEHQAPNFEPPTEIFPESN

SEQ ID NO: 564 - protein, 378 aa, Chlamydia pneumoniae
  CPn0562
NYKVIMSIAIAREQYAAILDMHPKPSIAMFSSEQARTSWEKRQAHPYLYRLLEIIWGVVKFLLGLIFFIPLGLFWVLQKICQNFILLGAGGWIFRPICRDSNLLRQAYAARLFSASFQDHVSSVRRVCLQYDEVFIDGLELRLPNAKPDRWMLISNGNSDCLEYRTVLQGEKDWIFRIAEESQSNILIFNYPGVMKSQGNITRNNVVKSYQACVRYLRDEPAGPQARQIVAYGYSLGASVQAEALSKEIADGSDSVRWFVVKDRGARSTGAVAKQFIGSLGVWLANLTHWNINSEKRSKDLHCPELFIYGKDSQGNLIGDGLFKKETCFAAPFLDPKNLEECSGKKIPVAQTGLRHDHILSDDVIKEVAGHIQRHFDN

SEQ ID NO: 565 - protein, 607 aa, Chlamydia pneumoniae
  CPn0563
QYKNLLWDFSPKGPCGIKFMTNSDNASAAGLLWAHPKEDPAFLGMIIKEFHLPPTVAQIFISRGFQTIQEIHKFLYSHLSSLYDPGLFLDMSKAVERLLLARDRKEHVMIYGDSDVDGMTGVALLVEFLRDIDVHVSYFFLGAILKQHGETSTLIAKLKEEGITLLITVDCGITAGKEVSDITRQGIDVIITDHHMPTGKIPHCVATLNPKLRDHTYPNRELTGVGVAFKLARGVLNALISRNLVPKSQGSLKKLLDLVTLGTITDVGVLLGENRVMVRYGIKEIARGARPGLNKLCALCGVEKSEVTSTDIVLKIAPKLNSLGRLDDPAKGVELLLTQDDERVDALIMELDNINRERQRIEAEVFQDVQEILNSNPEILKQAAIVLSSTAWHARVIPIISARLAKTYNKPVVIIAIQRGIGKGSARTIGSFPLLGVLKKCSSLLLSYGGHDFAAGVIMKEDKVEDFKKKFVHLVNSSLKKGDTLPHLEIDAYADFDAIDYDLLASMELFEPFGKGNLMPIFYSKVRQVRYPKVLPGNHLKLYLSQKERNLEGVAFGLGRHADALKASWHYPLEIAYTPRLSQTSGSGVIHLLVRDFRISSEPRFSD

SEQ ID NO: 566 - protein, 1405 aa, Chlamydia pneumoniae
  CPn0564
SGAMKQKVKRNFAIIICVFALALYYVLPTCLYYAKPLDKKIDGNEAEHIIKSFTKQAQQVRKDVIPRVSAILSSLHLRGHIQQHPAIPDIVSVRFKRGEDAEDFIGNLVHGEPNVPIKSARLHVVGYSREHDDHVIQVASSINTSLVESDFSFVSYSSENEQEMASSILQRVYSACTFPKQKDCSCSYPSIWETAPKEQLLQYAKNLSSGFEVFSSRLSAFCQQSFSSNQDRLAFLSRLSSLSNDAAIDVEDQKLLKSVYETLSQTACIRSLDCPYIEGLRLDCSESSLFFSSIEYCPKERKIFLTLHSDLLAQRTSLSKEQRLDFDSRLAVEKQKLSKNLTVQVEDYNNGFSFQWMDKDTQGKIILQGERLLQGIAEHLTALTLHRPAAESCDLIPENFPVFCRQPRESEAFGCYIFSPNTDCKHFSKGSVYILLKGLRSIVAKYQQGGGKELQSFEKDLQNLYNCFSHTEAISWTLGEDQVLEIRHPLQQFLDVWGEGFVIGKEGCAFLEVKDIQDRLATVNQIEKNRQSDLVRWHEQYRHAKCSMDLQERLSAPIPYQNLFLENMKLNMRKFSRGENILRLGIDFVGGRQLLLSFKDHQGKQLTDKEDILKVSDELCARLNKLGVSEIELRREGDYIHLSVPGSSTISSSEILGTSKMSFHVVNERFSSYSASRYEVQRFLDYLWFTSQAQGKTSPEEINTFASALFNEEVDVPPSVHEAITKLKSEGLAFSPSGCETPSTDLDTTFSMIAIGKDAEQKANPLVIVFRNYALDGASLKDIRPEFAAGEGYVLNFSVKDTSPKKMAEKLSPTESFHTWTSAYCQEGISGTANGQYSANRGWRMAVVIDGYMVSSPILNVPLKNHASVSGKFTHREVSKLASDLKSGAMSFVPEVLSEETISSDLGKKQCTQGIISACCGLAMLIVLMSVYYRFGGVIASGAVLLNLLLIWAALQYLDAPLTLSGLAGIVLAMGMAVDANVLVFERIREEFLLSQSLKKSVEKGYTKAFGAIFDSNLTTVLASALLFFLDTGPIKGFALTLILGIFSSMFTALFMTKFFFMLWMNKTQHTQLHMMNKFVGIKHDFLRGCKKLWAVSGSVFLLGCVALGFGAWNSVLGMDFKGGYAFTFNPKEHGISDVAQMRGKVVHKLQEAGLSSRDFRIQTFGSSEKIKIYFSDKALSYTKADTSLSPKINDHELALAVGLLSETGLDFSTETLNETQNFWSKVSSKLSKKMRYQATIGLLGALAIILLYVSLRFEWQYAFSAVCALIHDLLATCAVLFIAHFFLKKIQIDLQAIGALMTVLGYSLNNTLIIFDRIREDRQANLFTPMHVLVNDALQKTFSRTVMTTATTLSVLLMLLFIGGSSVFNFAFIMTIGILLGTLSSLYIAPPLLLFMVRKENRSK

SEQ ID NO: 567 - protein, 403 aa, Chlamydia pneumoniae
  CPn0565
NKLFCFLIFCFVNISAILFDSSFLLKIKRNSKRMLRSMKFPRISISDLIPTQMVIWWRGGGNVHYVPNAQNLPKKILGGVLACFGLALLGCAAFAAGVCQTIFPCIGLMILGLVLLGFAYLQYSKGWSRFERPLFRETKVFEKPINWLGCLSLLQSWKKIRPGCYYHPGCPQVEICEGSQEIVTKIFQKKSDRNTSIFLIQEMDQIALRQGIEKSSLSRKTFAIDPSVVSSLLSEIQREEQQYLDPKVISWSSEDQASDRTHPKSAIYVNISDAAQEPQGRCYIDAYTKAFFTVLDQIGDPNIVKKHTIYVLTPILGVPDALPKEEQENLKLLSQAAFLYSAEQVAKRMREEKQDSIRIKFIFTDPTSPTSLYFSPHHSSTPHSVTPISLSGFVGEQESYTFA

SEQ ID NO: 568 - protein, 264 aa, Chlamydia pneumoniae
  CPn0566
ERIVTYALINDPVDLSLATNNAESKFPSLQRLPNHVAIIMDGNRRWYKKHREECGHTHTSGHYYGAKVLPNILNAVLDLGIKVLTLYTFSTENFGRPKEEIQEIFNIFYTQLDKQLPYLMENEICLRCIGDLSKLPKGIQTKINHVSRMTASFSRLELVLAVNYGGKDELVRAFKKLHVDILNKKISSDDLSESLISSYLDTSGLTDPDLLIRTGGEMRVSNFLLWQIAYTELYITDTLWPDFTPQDLFEAINVYQQRSRRGGK

SEQ ID NO: 569 - protein, 308 aa, Chlamydia pneumoniae
  CPn0567
VLNSNKFKSKTGAYGDLFQRVVVHSLVLTFLVLLLYSSLFPLTSFALGFITATCGAVGTYEYSSMAKAKMHYPLSTFSAIGSFLFLALSFLSIRWGHSLPGFFDALPWTLLIVWVVWSIFRVRKSTIGALQLSGVTLFSILYVGIPIRLFLHVLYSFIHTQEPYLGIWWASFLIATTKGADIFGYFFGKAFGNKKIAPQISPNKTVVGFVAGCLGATLISFIFFLQIPTRFASYFPMPAILIPLGLALGITGFFGDIIESIFKRDAHLKNSNKLKAVGGMLDTLDSLLLSTPIAYLFLLITQSKEFIG

SEQ ID NO: 570 - protein, 220 aa, Chlamydia pneumoniae
  CPn0568
RVYWMIITIDGPSGTGKSTTAKALADHLHFNYCNTGKMYRTLAYARLQSPWATLPLTKFLEEPPFSFTFATGQPLESFFNGHLLTSELTTQEVANAASELSQLPEVRAFMQDLQRRYAQLGNCVFEGRDMGSKVFPNADLKIFLTSSPEVRAQRRLKDLPEGTLSPEQLQAELVKRDAADAQRAHDPLVIPENGIVIDSSDLTIRQVLEKILALLFRNEL

SEQ ID NO: 571 - protein, 234 aa, Chlamydia pneumoniae
  CPn0569
LFGFDNKTSSGENFSFTISKRAMIFRICKFFTWVAFSLFYKLKVYGVKKNFIKGPAIIAVNHNSFLDPIALHMCVHECIYHLARASLFNIPWLWKQWGCFPVRQDEGNSAAFKIASRLFNKRKKLVIYPEGARSPDGQLQPGKVGIGMMAAKSRVPIIPVYIRGTFEAFNRHQKIPHVWKTITCVFGTPMYFDDIIQNPEIKNKETYQIITNQTMNKIAELKAWYESGCKGDVP

SEQ ID NO: 572 - protein, 582 aa, Chlamydia pneumoniae
  CPn0570
TKLPSSKHGMNRGAKETSPKLMSTLLSILSVICSQAIAKAFPNLEDWAPEITPSTKEHFGHYQCNDAMKLARVLKKAPRAIAEAIVAELPQEPFSLIEIAGAGFINFTFSPVFLNQQLEHFKDALKLGFQVSQPKKIIIDFSSPNIAKDMHVGHLRSTIIGDSLARIFSYVGHDVLRLNHIGDWGTAFGMLITYLQENPCDYSDLEDLTSLYKKAYVCFTNDEEFKKRSQQNVVALQAKDPQAIAIWEKICETSEKAFQKIYDILDIVVEKRGESFYNPFLPEIIEDLEKKGLLTVSNDAKCVFHEAFSIPFMVQKSDGGYNYATTDLAAMRYRIEEDHADKIIIVTDLGQSLHFQLLEATAIAAGYLQPGIFSHVGFGLVLDPQGKKLKTRSGENVKLRELLDTAIEKAEEALREHRPELTDEAIQERAPVIGINAIKYSDLSSHRTSDYVFSFEKMLRFEGNTAMFLLYAYVRIQGIKRRLGISQLSLEGPPEIQEPAEELLALTLLRFPEALESTIKELCPHFLTDYLYNLTHKFNGFFRDSHIQDSPYAKSRLFLCALAEQVLATGMHLLGLKTLERL

SEQ ID NO: 573 - protein, 477 aa, Chlamydia pneumoniae
  CPn0571
TFEKVNVSFSDFDAKGERRMQIAQVFGCGRLNGEVKVSGAKNAATKLLVASLLSDQKCTLRNVPDIGDVSLTVELCKSLGAHVSWDKETEVLEIYTPEIQCTRVPPTFSNVNRIPILLLGALLGRCPEGVYVPTVGGDAIGERTLNFHFEGLKQLGVQISSDSSGYYAKAPRGLKGNYIHLPYPSVGATENLILAAIHAKGRTVIKNVALEAEILDLVLFLQKAGADITTDNDRTIDIFGTGGLGSVDHTILPDKIEAASFGMAAVVSGGRVFVRNAKQELLIPFLKMLRSIGGGFLVSESGIEFFQERPLVGGVVLETDVHPGFLTDWQQPFAVLLSQAQGSSVIHETVHENRLGYLHGLQHMGAECQLFHQCLSTKACRYAIGNFPHSAVIHGATPLWASHLVIPDLRAGFAYVMAALIAEGGGSIIENTHLLDRGYTNWVGKLRSLGAKIQIFDMEQEELTTSPKSLALRDASL

SEQ ID NO: 574 - protein, 756 aa, Chlamydia pneumoniae
  CPn0572
IMAAPINQPSTTTQITQTGQTTTTTTVGSLGEHSVTTTGSGAAAQTSQTVTLIADHEMQEIASQDGSAVSFSAEHSFSTLPPETGSVGATAQSAQSAGLFSLSGRTQRRDSEISSSSDGSSISRTSSNASSGETSRAESSPDLGDLDSLSGSERAEGAEGPEGPGGLPESTIPHYDPTDKASILNFLKNPAVQQKMQTKGGHFVYVDEARSSFIFVRNGDWSTAESIKVSNAKTKENITKPADLEMCIAKFCVGYETIHSDWTGRVKPTMEERSGATGNYNHLMLSMKFKTAVVYGPWNAKESSSGYTPSAWRRGAKVETGPIWDDVGGLKGINWKTTPAPDFSFINETPGGGAHSTSHTGPGTPVGATVVPNVNVNLGGIKVDLGGINLGGITTNVTTEEGGGTNITSTKSTSTDDKVSITSTGSQSTIEEDTIQFDDPGQGEDDNAIPGTNTPPPPGPPPNLSSSRLLTISNASLNQVLQNVRQHLNTAYDSNGNSVSDLNQDLGQVVKNSENGVNFPTVILPKTTGDTDPSGQATGGVTEGGGHIRNIIQRNTQSTGQSEGATPTPQPTIAKIVTSLRKANVSSSSVLPQPQVATTITPQARTASTSTTSIGTGTESTSTTSTGTGTGSVSTQSTGVGTPTTTTRSTGTSATTTTSSASTQTPQAPLPSGTRHVATISLVRNAAGRSIVLQQGGRSQSFPIPPSGTGTQNMGAQLWAAASQVASTLGQVVNQAATAGSQPSSRRSSPTSPRRK

SEQ ID NO: 575 - protein, 241 aa, Chlamydia pneumoniae
  CPn0573
VEDMAGHSKWANTKHRKERADHKKGKIFSRIIKELISAVKLGGADPKSNARLRMVIQKAKENNIPNENIERNLKKATSAEQKNFEEVTYELYGHGGVGIIVEAMTDNKNRTASDMRIAINKRGGSLVEPGSVLYNFARKGACTVAKSSIDEEVIFSYAIEAGAEDLDTEDEENFLVICAPSELASVKEKLISQGATCSEDRLIYLPLRLVDCDEKDGEANLALIDWLEQIEDVDDVYHNMS

SEQ ID NO: 576 - protein, 195 aa, Chlamydia pneumoniae
  CPn0574
SAERGFRHPIVMVETVLHNFQRYLSKYLYRVFRFPCRKKTFLSSHRVLARPSFPVDYCPGKIYDLQEIYEELNAQLFQGALRLQIGWFGRKATRKGKSVVLGLFHENEQLIRIHRSLDRQEIPRFFMEYLVYHEMVHSVVPREYSLSGRSIFHGKKFKEYEQRFPLYDRAVAWEKANAYLLRGYKKRVGGGYGRA

SEQ ID NO: 577 - protein, 181 aa, Chlamydia pneumoniae
  CPn0575
SIFGRVWRSFMTAEKQNTGILGLEIRYTLPSDATYMLKWLNDPKILRGFPIQTEAEIRETVNFWVGFYRYHSSLTAVYNGNVAGVATLVLNPYVKVSHHALISIIVGEEFRNKGIGTALLNNLIHLAKTRFKLEVLYLEVYEGNPALHLYQRFGFVEVGRQNRFYKDEIGYLAKTTMEKDL

SEQ ID NO: 578 - protein, 23 aa, Chlamydia pneumoniae
  CPn0576 and CPn0576.1
MQENLDKRLEALRTEISLAARSL

SEQ ID NO: 579 - protein, 90 aa, Chlamydia pneumoniae
  CPn0577
ESPMSQKNKNSAFMHPVNISTDLAVIVGKGPMPRTEIVKKVWEYIKKHNCQDQKNKRNILPDANLAKVFGSSDPIDMFQMTKALSKHIVK

SEQ ID NO: 580 - protein, 326 aa, Chlamydia pneumoniae
  CPn0578
TTNSFIVLISISLATLPILAFSWASFIEPNWLRTTAIPWRLPKKHAHLHGLRIAQISDLHFHKRVPEKFLNKVSKSIKNFSPDLIVFCGDLLCRARLEDKERLETFLNTLEAPLGVFAILGNHDYSSYISRNTKGEITCIPEEKSRPIQRAIIAVMQGLFSSPSYRYDPNLTPQEPHPDLLKLLKNTPLTLLHNTTHVIPNTLNIVGLGDLFARQFHPEQAFKNYDPSLPGLLLSHNPDGITRLQQYPGDFVLSGHSHGPQVTLSWPKFARKFFERLSGLENPYLARGYFVTKEGKQLYVNRGLGGLKRIRFCSPPEICYITCSYD

SEQ ID NO: 581 - protein, 228 aa, Chlamydia pneumoniae
  CPn0579
KEFASAPLLKSATSHVPMIKSSLILLSGGQGTRFGSKIPKQYLPLNGTPLVLHSLKILSSLPQIAEVIVVCDPSYQETFQEYPVSFAIPGERRQDSVFSGLQQVSYPWVIIHDGARPFIYPDEIHDLLETAEKIGATALASPIPYTIKQRNPVRTLDRDNLAIIHTPQCIKTEILREGLALAKEKQLTLVDDIEAAEIIGKPSQLVFNKHPQIKISYPEDLTIAQALL

SEQ ID NO: 582 - protein, 286 aa, Chlamydia pneumoniae
  CPn0580
ASSNQNFLPRRSNDCPSPPMTKVALLIAYQGTAYSGWQQQPNDLSIQEVIESSLKKITKTRTPLIASGRTDAGVHAYGQVAHFRAPDHPLFANANLTKKALNAILPKDIVIRDVALFDDNFHARYLAIAKEYRYSLSRLAKPLPWQRHFCYTPRHPFSTELMQEGANLLIGTHDFASFANHGRDYNSTVRTIYTLDIVDKGDSLSIICRGNGFLYKMVRNLVGALLDVGKGAYPPEHLLDILEQKNRREGPSAAPAYGLSLHHVCYSSPYNNFCCEQCSVSTSNEG

SEQ ID NO: 583 - protein, 263 aa, Chlamydia pneumoniae
  CPn0581
EGLRWRSVKSFLRQCWIYSMLVSDEFQLCLRSGMYLEDYDVFFFDLDGLLVDTEPCFYRAFLQACAEFSLEVHWDFSTYYSHTTLGTEIFSKKFIEQYPQAQEYMAEIFAKRLQIYYKSLEHAGPALMPGVEAFIELVLSLNKTFGVVTNSPRDATHTLRTMYPILNKFLFWVTRENYARPKPYGDSYDYAYRTFAREGMKVIGFEDSVKGLRALSKIPATLVCINSMAEITPEDYPELKGKEFFSYPSFDVLTEHCSQQKLL

SEQ ID NO: 584 - protein, 291 aa, Chlamydia pneumoniae
  CPn0582
KNPNALLKKIQHRLVKMHDKNKVLYLQANHLNQKRKRHNPLNTYHSSNTTETRRLPTYYKSNIVLKMILRISTVSLLTSCSFSKNSRTCFVTPERITSQKDCPVLLHPKSTTISPPLYDWISPNREVITAYSFYCRGQGNSIITPEGVLYDCDGLHHSITKEEFRYIHPRLIEVVRLLQQDHPKVSIIEAFCCPKHFHFLEASGISLSQLHLQGTAATFALDPPLPMEKLLATIKKLYKKNSDPSLSNFIVTEATLTNPELRLTQQDLGSHTEITVEILDNLQNKEALSSA

SEQ ID NO: 585 - protein, 123 aa, Chlamydia pneumoniae
  CPn0583
IVLSFFLGKTKVTPRFLMNERTLLLLLKKKKGLFLAILDLTQTESSLTTPELEKVLKQKKIFLSCIDRVDLQIKEFRHAFSSELPQDIQEELEEIRDVIIRILDTDKRNYAQKKKEFGIYERP

SEQ ID NO: 586 - protein, 380 aa, Chlamydia pneumoniae
  CPn0584
IRINATMHRKKRNLVFMNVPDSKNLHPPAYELLEIKARITQSYKEASAILTAIPDGILLLSETGHFLICNSQAREILGIDENLEILNRSFTDVLPDTCLGFSIQEALESLKVPKTLRLSLCKESKEKEVELFIRKNEISGYLFIQIRDRSDYKQLENAIERYKNIAELGKMTATLAHEIRNPLSGIVGFASILKKEISSPRHQRMLSSIISGTRSLNNLVSSMLEYTKSQPLNLKIINLQDFFSSLIPLLSVSFPNCKFVREGAQPLFRSIDPDRMNSVVWNLVKNAVETGNSPITLTLHTSGDISVTNPGTIPSEIMDKLFTPFFTTKREGNGLGLAEAQKIIRLHGGDIQLKTSDSAVSFFIIIPELLAALPKERAAS

SEQ ID NO: 587 - protein, 672 aa, Chlamydia pneumoniae
  CPn0585
ISLRRKILRPNNFSIGDCSSNMATPAQKSPTFQDPSFVRELGSNHPVFSPLTLEERGEMAIARVQQCGWNHTIVKVSLIILALLTILGGGLLVGLLPAVPMFIGTGLIALGAVIFALALILCLYDSQGLPEELPPVPEPQQIQIEDLRNETREVLEGTLLEVLLKDRDAKDPAVPQVVVDCEKRLGMLDRKLRREEEILYRSTAHLKDEERYEFLLELLEMRSLVADRLEFNRRSYERFVQGIMTVRSEEGEKEISRLQDLISLQQQTVQDLRSRIDDEQKRCWTALQRINQSQKDIQRAHDREASQRACEGTEMDCAERQQLEKDLRRQLKSMQEWIEMRGTIHQQEKAWRKQNAKLERLQEDLRLTGIAFDEQSLFYREYKEKYLSQKLDMQKILQEVNAEKSEKACLESLVHDYEKQLEQKDANLKKAAAVWEEELGKQQQEDYEQTQEIRRLSTFILEYQDSLREAEKVEKDFQELQQRYSRLQEEKQVKEKILEESMNHFADLFEKAQKENMAYKKKLADLEGAAAPTEIGEDDDWVLTDSASLSQKKIRELVEENQELLKALAFKSNELTQLVADAVEAEKEISKLREHIEEQKEGLRALDKMHAQAIKDCEAAQRKCCDLESLLSPVREDAGMRFELEVELQRLQEENAQLRAEVERLEQEQFQG

SEQ ID NO: 588 - protein, 397 aa, Chlamydia pneumoniae
  CPn0586
KEKMNPSRGENMAIKNILVVDDEPLLRDFLSELLTSQGFIPDTAENLRNALQMIRSRDYDLVISDMSMPDGSGLDLIKIIKQSSPHTPVLVVTAYGSIENAVEAMHQGAFNYLTKPFSSEALFAFISKAEELKNLVHENLFLHSQTTPDSHPLIAESKAMKDLLAIAKKAASSSANIFIHGESGCGKEVLSFFIHHNSPRANHPYIKVNCAAIPETLLESELFGHEKGAFTGATTKKAGRFELAHKGTLLLDEITEVPVNLQAKLLRAIQEKEIEHLGGTKTLSVDVRILATSNRKLKEAIDDKSFRQDLYYRLNVIPLHLPPLRDRQDDILPLANYFLNKFCRMNNTPLKTLSPKAQELLLNYPWPGNIRELSNVLERVVILENTSLLTEDMLALA

SEQ ID NO: 589 - protein, 249 aa, Chlamydia pneumoniae
  CPn0587
SYGELFILSTLLKHHVTLGDKMRPHRKHVSSKSLALKQSASTHVEITTKAFRLSMPLKQLILEKSDHLPPMETIRVVLTSHKDKLGTEVHVVASHGKEILQTKVHNANPYTAVINAFKKIRTMANKHSNKRKDRTKHDLGLAAKEERIAIQEEQEDRLSNEWLPVEGLDAWDSLKTLGYVPASAKKKISKKKMSIRMLSQDEAIRQLESAAENFLIFLNEQEHKIQCIYKKHDGNYVLIEPSLKPGFCI

SEQ ID NO: 590 - protein, 198 aa, Chlamydia pneumoniae
  CPn0588
TSKSIKSNAFIKNMTATMSLLNLPSSQDSASEDSTSQSQIFDPIRNRELVSTPEEKVRQRLLSFLMHKLNYPKKLIIIEKELKTLFPLLMRKGTLIPKRRPDILIITPPTYTDAQGNTHNLGDPKPLLLIECKALAVNQNALKQLLSYNYSIGATCIAMAGKHSQVSALFNPKTQTLDFYPGLPEYSQLLNYFISLNL

SEQ ID NO: 591 - protein, 254 aa, Chlamydia pneumoniae
  CPn0589
SSMQICVTGVVLRSRPLGKNHTLTTLFTPEGLFTFFAKQGQTLQCDYRETLVPISLGKYTLHRNGSRLPKLTHGDILNAFEAIKQTYALLEASGKMIQALLASQWKEKPSHKLFSLFLNFLHRIPESSNPEFFAAIFVLKLLQYEGILDLTPACSLCKASLPYACYRYQGHKLCKKHQHKQAISIEKEEEQILQAIIHAKQFSELLAIAEFPIAIAEKIFYLFDSLQEEKKSERNSSEDPYHEILRLSKVVHPY

SEQ ID NO: 592 - protein, 207 aa, Chlamydia pneumoniae
  CPn0590
LFLYGDHNLGFACRYLFFFIVLFASGSFGNQLLSVPCWLSEEESFYTHRFDFSKSYPDMENMEIQAQRKKRVEFNLTGEFPKLETLNYQGSFGHLRAKCRGVYPVLYALNFSCSSCKMDMDFRGKWNRSSTITISNQKESINLKLPKDVGVIVNTKTSLKGNVCPGSTFIKQGWGVWNKIYHNDLVGFSEVTLIFNVSSEGGTITFS

SEQ ID NO: 593 - protein, 219 aa, Chlamydia pneumoniae
  CPn0591
SLIMRCTAYCTASAYNLHVLFHLLKPRYPTILSREYVLANLDSTQASNQLAIFFPFGVAVFWGWEESEEIKLLQTIVTASPEILPQPEIDCYNFHYGDKLQIRRDRLTLADTTLNTKLAIAFGLAQSVKLTTFETTIYKTIEDSKRLPQDLATKGKISMSRKAIAKKIGKLFLDKASVNLHSDILDEPDFFWDHPETQAIYRDVLSCLDIEARINVLIV

SEQ ID NO: 594 - protein, 110 aa, Chlamydia pneumoniae
  CPn0592
LYSKMFSMSFKRFLQQIPVRICLLIIYLYQWLISPLLGSCCRFFPSCSHYAEQALKSHGFLMGCWLSIKRIGKCGPWHPGGIDMVPKTALQEVLEPYQEIDGGDSSHFSE

SEQ ID NO: 595 - protein, 368 aa, Chlamydia pneumoniae
  CPn0593
VLGAKCMAFKRKTRWLWQVLILSVGLNMLFLLLFYSAIFRKDIYKLHLFSGPLIAKSSRKVYLSEDFLNEISQASLDDLISLFKDERYMYGRPIKLWALSVAIASHHIDITPVLSKPLTYTELKGSSVRWLLPNIDLKDFPVILDYLRCHKYPYTSKGLFLLIEKMVQEGWVDEDCLYHFCSTPEFLYLRTLLVGADVQASSVASLARMVIRCGSERFFHFCNEESRTSMISATQRQKVLKSYLDCEESLAALLLLVHDSDVVLHEFCDEDLEKVIRLMPQESPYSQNFFSRLQHSPRRELACMSTQRVEAPRVQEDQDEEYVVQDGDSLWLIAKRFGIPMDKIIQKNGLNHHRLFPGKVLKLPAKQS

SEQ ID NO: 596 - protein, 814 aa, Chlamydia pneumoniae
  CPn0594
NTCHYTQVIVKSLVKYSLRLSSMRIPITLLQTYFSEPLSTKEILEACDHIGIEAEIENTTLYSFASVITAKILHTIPHPNADKLRVATLTDGEKEHQVVCGAPNCEAGLIVALALPGAKLFDSEGQAYTIKKSKLRGVESQGMCCGADELGLDELQIQERALLELPEATPLGEDLATVLGNTSLEISLTPNLGHCASFLGLAREICHVTQANLVIPKEFSFENLPTTALDMGNDPDICPFFSYVVITGISAQPSPIKLQESLQALKQKPINAIVDITNYIMLSLGQPLHAYDASHVALDSLRVEKLSTPESLTLLNGETVLLPSGVPVVRDDHSLLGLGGVMGAKAPSFQETTTTTVIKAAYFLPEALRASQKLLPIPSESAYRFTRGIDPQNVVPALQAAIHYILEIFPEATISPIYSSGEICRELKEVALRPKTLQRILGKSFSIEILSQKLQSLGFSTTPQETSLLVKVPSYRHDINEEIDLVEEICRTESWNIETQNPVSCYTPIYKLKRETAGFLANAGLQEFFTPDLLDPETVALTRKEKEEISLQGSKHTTVLRSSLLPGLLKSAATNLNRQAPSVQAFEIGTVYAKHGEQYQETQTLAILLTEDGESRSWLPKPSLSFYSLKGWVERLLYHHHLSIDALTLESSALCEFHPYQQGVLRIHKQSFATLGQVHPELAKKAQIKHPVFFAELNLDLLCKMLKKTTKLYKPYAIYPSSFRDLTLTVPEDIPANLLRQKLLHEGSKWLESVTIISIYQDKSLETRNKNVSLRLVFQDYERTLSNQDIEEEYCRLVALLNELLTDTKGTINS

SEQ ID NO: 597 - protein, 328 aa, Chlamydia pneumoniae
  CPn0595
RDYQFMKQLLFCVCVFAMSCSAYASPRRQDPSVMKETFRNNYGIIVSGQEWVKRGSDGTITKVLKNGATLHEVYSGGLLHGEITLTFPHTTALDVVQIYDQGRLVSRKTFFVNGLPSQEELFNEDGTFVLTRWPDNNDSDTITKPYFIETTYQGHVIEGSYTSFNGKYSSSIHNGEGVRSVFSSNNILLSEETFNEGVMVKYTTFYPNRDPESITHYQNGQPHGLRLTYLQGGIPNTIEEWRYGFQDGTTIVFKNGCKTSEIAYVKGVKEGLELRYNEQEIVAEEVSWRNDFLHGERKIYAGGIQKHEWYYRGRSVSKAKFERLNAAG

SEQ ID NO: 598 - protein, 176 aa, Chlamydia pneumoniae
  CPn0596
FAVMADDTLIPKLMKNSLSQACSEGLLIAKYPPLQVIVHFDNNLVVKTHLSVAPVFSCLFLGPAAHKAMQEIVLWCSRYANKEHPPFSSHFAKDLIPSQYLEILNCVAEIPFGEQQTYAEIAKKTDTHPRTVGAACKQNPFLLFFPCHRVVGSHGERNYVLGPVIHEILLKFENSY

SEQ ID NO: 599 - protein, 579 aa, Chlamydia pneumoniae
  CPn0597
MQKHPSFYQRFLSAYYKNLLASLSWKFFISVALIGIYAPLFASSKPLLVTWHGEIFFPLLRYLFFPGYYTKPVDLFFNVLMVTFPFFILSFKLTRGWLRRWLLGLCIISQCMIFAWAYSGKVQDPALAENLKKMRAEKVRENISKVNSEMVMLLPKDTRTWEMERRYMSTYEQLGILIKAKYRKKQEASVKKYQVAFEEKRQSPMPTLRHLEMKNEGICLKRLQQRVDKMQRPYEMAQQAWNRATDNYRPFLMALTRIEHELRLADYNNWGQPEDLCIAYANVEKRAEPYKKSLLEIRQVLEDYAKLRSAISFIQDKRLWIEKESEDLRILINPFFSSFHWEDDAGGSREMNKYVPWWQLSRVTRKDLLAALVFGIRIALVVAGIGITIALAIGIMIGLVSGYFGGTVDMILSRFTEIWETMPVLFILMLVISITQQKSLLLNTVLLGCFSWTGFSRYVRIEVLKQRDRGYVLAATNLGYSHYYIMVHQILPNAIVPVISLVPFAMMAMISCEAGLTFLGLGEESSASWGNLMREGVTGFPAESAVLWPPAIILTMLLIAIALIGDGVRDALDPRLQDS

SEQ ID NO: 600 - protein, 498 aa, Chlamydia pneumoniae
  CPn0598
EEGGSVLKYILKRLVLIPLTLFAIVSINFVILNAAPGDVLEEKSRDALGEAGKSDKMRSYKGPDRYLQFREHYGLTLPIFFNTRPKITHKKIQTALQELANANNTTPSAKNAAKSLVYWGDCAKFVMPALLFEADDASRDDKYRHIAADLFIRGGVLQGFVGPNLSPEQRAQNKEIAESNAFLVRQLNEEDLDTKVEALKGWFQDHGGTEVFCYSSKQFWKTFFLETRFARYMSRVLRLDFGTLRNDAHKTVISEVIKRLRCSLVLSILPMIVGFVLCQIFGMIMALKRNRWIDHSLNFIFLILFSIPVFVAVPWILDNFVINKTIPFTTIPMPYSGLRSPPEVFNELSTLGRIFDLVSHGFLPFCAVSYGALAAQSRLSRSIFLEVLSQDFICAAKARGLRWFDILYKHVGKNAAVSIVTSLASSLGTLLGGALVVETLFNIDGFGNFFYQAILNRDHNVVLFSVLVGSALSLVGYLLGDICYVLLDPRVQLEGRRI

SEQ ID NO: 601 - protein, 714 aa, Chlamydia pneumoniae
  CPn0599
KRRESGHMYKRCVLDKILKGIVAGSLILLYWSSDLLERDIKSIKGNVRDIQEDIREISRVVKQQQTSQAIPAAPGVMLAPKLVRDEAFALLFGDPSYPNLLSLDPYKQQTLPELLGTNFHPHGILRTAHVGKPENLSPFNGFDYVVGFYDLCIPSLASPHVGKYEEFSPDLAVKIEEHLVEDGSGDKEFHIYLRPNVFWRPIDPKALPKHVQLDEVFQRPHPVTAHDIKFFYDAVMNPYVATMRAVALRSCYEDVVSVSVENDLKLVVRWKAHTVINEEGKEERKVLYSAFSNTLSLQPLPRFVYQYFANGEKIIEDENIDTYRTNSIWAQNFTMHWANNYIVSCGAYYFAGMDDEKIVFSRNPDFYDPLAALIDKRFVYFKESTDSLFQDFKTGKIDISYLPPNQRDNFYSFMKSSAYNKQVAKGGAVRETVSADRAYTYIGWNCFSLFFQSRQVRCAMNMAIDRERIIEQCLDGQGYTISGPFASSSPSYNKQIEGWHYSPEEAARLLEEEGWIDTDGDGIREKVIDGVIVPFRFRLCYYVKSVTAHTIADYVATACKEIGIECSLLGLDMADLSQAFDEKNFDALLMGWCLGIPPEDPRALWHSEGAMEKGSANVVGFHNEEADKIIDRLSYEYDLKERNRLYHRFHEIIHEEAPYAFLFSRHCSLLYKDYVKNIFVPTHRTDLIPEAQDETVNVTMVWLEKKEDPCLSTS

SEQ ID NO: 602 - protein, 110 aa, Chlamydia pneumoniae
  CPn0600
HGYMKIKKSFQYSLCQAKRFQNMLPNHFDPCLQPVNLQLKQDRLAYGELIILLSKYQQKTFSSLLKEETCSLNRAKQHLLYKILRDFNTMQHLRSLGLNGWGEIPMSPCL

SEQ ID NO: 603 - protein, 119 aa, Chlamydia pneumoniae
  CPn0601
QFPRIHADDIINSMDEITPNYPLLRQDSLWNRVRVSWRADLSVSSRYEIASAIAILGLLVAFCASAAVSIIFTANPLAQVFIDGCLALGLLPIPLVIGLLIIGIIVLLYGIYLFPQQRE

SEQ ID NO: 604 - protein, 338 aa, Chlamydia pneumoniae
  CPn0602
DSGFMKPLGFQENLEALCNKTSRQLLKYLIKQILFVCGASLLIALEFSFFLYFFLFSGKTVIPAFCLACFFLTLFVCLVTRLYLLSGKGDFFEDLASEYLQGAVPPNKRSQNIVEEQSHLAAAATKLSINLQNQEYSLLSEIFKFLPKHDLIRKFSCFCFWKDYFLFRECLLQKAIEAYIKVVQAIPVDLSAHVSLADAYVALSGLYADPRKYPEFDANYWIPSGRYSAEIQEKFFATARRAIEEFQILNEYAPGNAWVHAQLAYSYHDLQMPMEEIQEYEIVLKLKPNDVETMSKLGILYFQQGMNAKGLRIYEEIKKRDYKKSQKLIKFYGVEYKY

SEQ ID NO: 605 - protein, 350 aa, Chlamydia pneumoniae
  CPn0603
WKIMRLIVLMQCLVSLFLAKKVTVTTPAYLLANFGGPRHAKDLQEFLISLLTDRDVTGTFLPRVLHRHLFTFIAKKRVPKVLPQYQSLQNWSPIYFDTETLAKTLSEILRAPVIPFHRYLPSTHEKTLLALRTLHTRHVIGIPLFPHFTYSVTGSIVRFFMKHVPEIPISWIPQFGSDSKFVSLITCHIRDFLQKLGILEKECCFLFSVHGLPVRYISQGDPYSKQCYESFSAITTNFKQSENFLCFQSKFGPGKWLSPSTAQLCQNIDTDKPNVIVVPFGFISDHLETLYEIERDYLPLLRSRGYRALRIPAIYSSPLWVSTLVDIVKENSTVVAEELIKSGKKHTGIR

SEQ ID NO: 606 - protein, 262 aa, Chlamydia pneumoniae
  CPn0604
CKKRQNSEAQLNVKIKFSWKVNFLICLLAVGLIFFGCSRVKREVLVGRDATWFPKQFGIYTSDTNAFLNDLVSEINYKENLNINIVNQDWVHLFENLDDKKTQGAFTSVLPTLEMLEHYQFSDPILLTGPVLVVAQDSPYQSIEDLKGRLIGVYKFDSSVLVAQNIPDAVISLYQHVPIALEALTSNCYDALLAPVIEVTALIETAYKGRLKIISKPLNADGLRLAILKGTNGDLLEGFNAGLVKTRRSGKYDAIKQRYRLP

SEQ ID NO: 607 - protein, 196 aa, Chlamydia pneumoniae
  CPn0605
LRKLCSSRGDVRILAGKYKGKSLKTFSNPHIRPTSGLVKEAFFSICREDIEGAAFLDLFAGMGAIGFEALSRGAASVVFVDISIKAIQLIHTNSALLGEQLPVVIFRQDAQSAIQRLIKQKRSFDLIYIDPPYELCNCYVETLLQKIVSGNILNPEGTLFLENASDEEIACEGLTLRRRRKLGKTYLAEYIVEKDP

SEQ ID NO: 608 - protein, 262 aa, Chlamydia pneumoniae
  CPn0606
SSYSRRQLRFYTGSLQMHIYGLADLHLALGVPEKTMEVFGDPWIGYHQKICSEWQAVVHPEDIVLLPGDISWAMNLSEAHKDFAFIGDLPGTKYMIRGNHDYWSSASTSKILQALPPSLYYLNQGFALLTPHLAVVGVRLWDSPTICVKKENFLTPSTQEQSYTEQDEKIFLRELGRLKRAFAALPKEVTEVIVMTHYPPISSDGTPGPISEFLEADGRVSLCLFGHIHKVQRPIDGFGNIRGIHYILVAADYVNFVPQEVM

SEQ ID NO: 609 - protein, 446 aa, Chlamydia pneumoniae
  CPn0607
NRRIQMIENDFPEASNFESSHFYRDKVGVIILCGGEGKRLSPLTNCRCKPTVSFGGRYKLIDIPISHAISAGFSKIFVIGQYLTYTLQQHLFKTYFYHGVLQDQIHLLAPEARQGDQIWYQGTADAIRKNLLYFEDTEIEYFLILSGDQLYNMDFRSIVDTAIRTHVDMVLVAQPIPEKDAYRMGVLDIDSEGKLIDFYEKPQEKEVLKRFQLSSEDRRIHKLTEDSGDFLGSMGIYLFRRDSLFSLLREEEGNDFGKHLIQAQMKRGQVQTLLYNGYWADIGTIESYYEANIALTQKPHAEKRGLNCYDDNGMIYSKNHHLPGAIITDSMISSSLLCEGCVINTSHVSRSVLGIRSKIGENSVVDQSIIMGNARYGSPSMPSLGIGKDCEIRKAIIDENCCIGNGVKLQNLKGYIKYDSPDKKLFVRDNIIIVPQGTHIPDNYIF

SEQ ID NO: 610 - protein, 225 aa, Chlamydia pneumoniae
  CPn0608
VSFLYFVKNGRRLWRMMNYEDAKLRGQAVAILYQIGAIKFGKHILASGEETPLYVDMRLVISSPEVLQTVATLIWRLRPSFNSSLLCGVPYTALTLATSISLKYNIPMVLRRKELQNVDPSDAIKVEGLFTPGQTCLVINDMVSSGKSIIETAVALEENGLVVREALVFLDRRKEACQPLGPQGIKVSSVFTVPTLIKALIAYGKLSSGDLTLANKISEILEIES

SEQ ID NO: 611 - protein, 105 aa, Chlamydia pneumoniae
  CPn0609
QNTKNSLIRENMLIRLFLGISLPKGFPLYLEPPLVLATFQGTQFVGTYSEATNPLYIDNLNLNYHYTQELLYKAVPCNYKSIYREIPLIIFPEVLIGSTPTQSTE

SEQ ID NO: 612 - protein, 474 aa, Chlamydia pneumoniae
  CPn0610
RIFLRFKGSIMKEERSSEILPRVKETKKHAYVSMQEKSCVGECAVVASESEEAESVTVTKIAKLQRMGIEELNILARQYGVKNIGSLTKSQVVFEIVKAKSERPDELLIGEGVLEVLPDGFGFLRSPTYNYLPSAEDIYVSPAQIRRFDLKKGDTIIGTIRSPKEKEKYFALLKVDKINGSTPDKAKERVLFENLTPLYPNQRIVMEMGKDHLAERVLDLTAPIGKGQRGLIVAPPRSGKTVILQSIAHAIAVNNPDIVLIVLLIDERPEEVTDMIRQVRGEVVASTFDEQPERHIQVAEMVIEKARRLVEHGNDVVILLDSITRLARAYNTVQPHSGKILTGGVDASALHKPKRFFGAARNIEGGGSLTILATALIDTGSRMDEVIFEEFKGTGNMELVLDRRLSDRRTYPAIDLIKSGTRKEELLYHPSELERVYLFRQAIADLTTIDAMHLLLGRLKKTNSNAEFLLSLKE

SEQ ID NO: 613 - protein, 238 aa, Chlamydia pneumoniae
  CPn0611
RRNRRDAKTSEREDGISYDFIRSYSCEYLNWKKLGRMLKLLKVSITGDLSSGKTEACQVFQELGAYVVSADEISHSFLIPHTRIGRRVIDLLGSDVVVDGAFDAQAIAAKVFYNSVLLQGLEAILHPEVCRIIEEQYHQSIQDGNYPLFVAEVPLLYEIHYAKWFDSVILVMANEDIRRERFMKKTGRSSEDFDQRCSRFLNVEEKLAQADVVVENNGTKKELHQKIEEYFYALKGAL

SEQ ID NO: 614 - protein, 889 aa, Chlamydia pneumoniae
  CPn0612
RCIHTSLLCTVERPRREYAMKKLFVLDASGFIFRAYFALPEMKNHQGQATQAVFGFIRSLNKLIKEFSPEYMISVFDGPNNKQSRQAIYADYKSNRQKKFEDIPPQIALVKEYCSLIGLAYLEKESVEADDVIASIAKKAREENYKVYVCTADKDLLQLVNDHVVAWNPWADQGVVGISEVIERYGIPPGNIPDYLALVGDSSDNIPGLPGCGPKKAAALLKQFGSVEGLLENLDAVKGLSQTMLSERQETLKLSKRLALLDSNIPIPVPIESLTFPQHPVDEEKLIHFYIQQGFKTLVPSKQTEAATVDVQIIKDAESLTNILNLVQGGDIAFAVAYTGNHLLSLKLEGLALTQGSGVFFIALEEEGTKILPILKDFFLREDLTFYGYNLKRDCHALLNAGIVIREISYDLALAEHLTNGGGKISFQSLLVNHGFTETAHRFAKEWGNSGLPIGRLPEQPEQYFGEFVAYLPIIKDAILEEINRKNLNHILSDIEMPLEKVLFSMERAGVPLDVEELAILEALFETELAVLTEEIYDLSGRPFNIKSPKQLSDILYNELGLRPIDKAKSTRAEVLEALRSEHPIIEKLLAFRTIEKLLSTYVKALPKQVDSHTQRIHPSFDQTGAVTGRLACRDPNLQNIPIRSERGILLRKAFRLSEKNSYFLSADYSQIELRFLAHLSQDKSLKFAFESGEDIHAFTASQVFHVPLEQVSKEQRMQAKTVNFGIVYGQQAFGLAKVLKISIGEAQELIQAYFSRYPEIAHFVEETIQQAAKDLRVTTMLGRERIIDSWNEFPGSRAASGRFAVNTRIQGSAAELIKLAMLDISQAIKQQQMKSRMLLQIHDELLFEVPEEEIEEMQRLVREKMESAMTLSVPIVVNILIGKNWAEC

SEQ ID NO: 615 - protein, 335 aa, Chlamydia pneumoniae
  CPn0613
VVMKTLWHFVSKAFLSIVGLCCGVVLAFVVIFALIASSLGNGDATFVSLPDAQGEVKDLGKTAPIIAVIEMKDVIASSKNTAKTIQNILEGFEKAPLKDRVKGIVIDMDCPGGEVFEIDRIYSMLRFWKERKGFPIYIYVNGLCASGGYYVSCAATKIYATSSSLIGSIGVRSGPFFNVKEGLNRYGVESDLLTAGKDKAPMNPYTPWTSHDREERQATLDFLYGQFVDIVTQNRPLLTKEKLVHTLGARIFSPEKAKQEGYIDVVGATKEQVLQDIVAVCKIEDNYRVIGSGGDGWWKRVASAAASSPLVTGMIKHDILPLSHDAAYIPPYLAL

SEQ ID NO: 616 - protein, 551 aa, Chlamydia pneumoniae
  CPn0614
VFIRHKVGKEFMQSSEVKPFSRLRAYLCPIYKSEFSKFVPLFLLAFFVGFNYCLLKNMKDTLVIVGSDAGAEVIPFLKVWGIVPGAVIVTMVYGWLGSRYPRDTVFYCFMAAFLGFFFLFAVIIYPVGDSLHLNSLADKLQELLPQGLRGFIVMVRYWSYSIYYVMSELWSSVVLSMLFWGLANQITTITEAGRFYALINTGLNLSSICAGEISYWMGKQTFVAYSFACDSWHSVMLNLTMLITCSGLIMIWLYRRIHHLTIDTSIPPSRRVLAEEGAATANLKEKKKPKAKARNLFLHLIQSRYLLGLAIIVLSYNLVIHLFEVVWKDQVSQIYSSHVEFNGYMSRITTLIGVVSVLAAVLLTGQCIRKWGWTVGALVTPLVMLVSGLLFFGTIFAAKRDISIFGGVLGMTPLALAAWTGGMQNVLSRGTKFTFFDQTKEMAFIPLSPEDKNHGKAAIDGVVSRIGKSGGSLIYQGLLVIFSSVAASLNVIALVLLIIMVVWIAVVAYIGKEYYSRAADAVATLKQPKEPSSSIVREAQESVEQEEMAVL

SEQ ID NO: 617 - protein, 172 aa, Chlamydia pneumoniae
  CPn0615
LAKIMRQFCNLLSLSRLWLALYFCQEKLHIRLLAIVGAMLSDVLDGYLARRYKATSRLGSILDPITDKVFVFVCITVLYMEGSLSIAHLFFICARDLFLIIFVCYLSLVKGWKGYDYGSLFWGKIFTVVQFIILLGVTAGGEIPWTGLVPLVALGFLYFLERIMDYKKQFLR

SEQ ID NO: 618 - protein, 478 aa, Chlamydia pneumoniae
  CPn0616
TLTNYESSLLMDKSTGVPLPSPPHSKESEMIVLGCMLTGVHYLNLAANQLYEEDFYYLEHKIIFRVLQDAFKQDKPIDVHLAGEELKRHNQITVIGGPSYLITLAEFAGTAAYLEEYVDIIRSKSILRKMISTAKEIEKRALEQPKNVAEALDEAQNSFFKISQSTSVSQYTLVADKLRGLTTTTDKPYLVQLQERQELFLQNAQGDNKSFFTGIPTHFIDLDQLIHGFSPSNLMILAARPAMGKTALALNIAENLCFQNRLPIGIFSLEMTVDQLIHRMICSRSEVDSKKISIGDLSGHDFQRIVSVINEMQEHTLLIDDQPGLKVSDLRARARRMKESYDIQFLIIDYLQLLSGSGTLRATESRQTEISEISRMLKTLARELNIPILCLSQLSRKVEDRANHRPMMSDLRESGSIEQDSDLVMFLLRREYYDPNDKPGTAELIIAKNRHGSIGSVPLVFEKELARFRNYSAFECIS

SEQ ID NO: 619 - protein, 612 aa, Chlamydia pneumoniae
  CPn0617
LMWTHPIAYDVIVVGAGHAGCEAAYCSAKMGVSVLMLTSNLDTIAKLSCNPAVGGIGKGHIVREIDALGGIMAEVTDQSGIQFRILNQTKGPAVRAPRAQVDKQLYHIHMKRLLENTPGLHIMQATVESLLDKEGVISGVTTKEGWMFSGKTVVLSSGTFMRGLIHIGDRNFSGGRLGDPSSQGLSEDLKKRGFPISRLKTGTPPRLLASSINFSCMEEQPGDLGVGFVHRTEPFQPPLPQLSCFITHTMEKTKAIISANLHRSALYGGCIEGVGPRYCPSIEDKIVKFSDKERHHVFLEPEGLHTQEIYANGLSTSMPFDVQYDMIRSVLGLENAIITRPAYAIEYDYIHGNVIHPTLESKLIEGLFLCGQINGTTGYEEAAAQGLIAGINAVNKVFNRPPFIPSRQESYIGVMLDDLTTQILDEPYRMFTGRAEHRLLLRQDNACARLSHYGYELGLLSEERYELVKKQNQLLEEEKVRLQKTFRQYGQSVVSLAKALSRPEVSYDMLREAFPNDIRDLGAVLNASLEMEIKYSGYIDRQKILIQSLEKAESLLIPEDLDYKQITALSLEAQEKLAKFTPRTLGSASRISGIASADIQVLMIALKKHAHH

SEQ ID NO: 620 - protein, 237 aa, Chlamydia pneumoniae
  CPn0618
KNMPTTNCIFLDLRGHSILHQLQIEEALLRVANQNFCIINSGAKDSIVLGISRNLNQDVHISRAQADHIPIIRRYSGGGTVFIDSNTLMVSWIMNSSEASAQPQELLAWTYGIYSPLLPNTFSIRENDYVLGHKKIGGNAQYIQRHRWVHHTTFLWDIDLDKLSYYLPIPQQQPTYRNQRSHEEFLTTLRPWFPSRDDFLERIKASGSLLFTWEEFLDNELEEILAQPHRKATTVLN

SEQ ID NO: 621 - protein, 150 aa, Chlamydia pneumoniae
  CPn0619
RRYVYTMEQTLSIIKPDSVSKAHIGEILSIFEQSGLRIAAMKMMHLSQTEAEGFYFVHRERPFFQELVDFMVSGPVVVLVLEGANAVSRNRELMGATNPAEAASGTIRAKFGESIGVNAVHGSDTLENAAVEIAYFFSKIEVVNASKPLV

SEQ ID NO: 622 - protein, 209 aa, Chlamydia pneumoniae
  CPn0620
DKMYDYIRGTLTYVHTGAIVIECQGIGYHIAITERWAIECIRALHQDFLVFTHVIFRETEHLLYGFHSREERECFRILISFSGIGPKLALAILNALPLKVLCSVVRSEDIRALASVSGIGKKTAEKLMVELKQKLPDLLPLDSRVETSQTHTTSSCLEEGIQALAALGYSKIAAERMIAEAIKDLPEGSSLTDILPIALKKNFSGVNKD

SEQ ID NO: 623 - protein, 188 aa, Chlamydia pneumoniae
  CPn0621
LSRLGSSFKDNKFKVFQESIVSELIIGVDPGTIVAGYAIIAVEQRYQLRPYSYGAIRLSSDMPLPMRYKTLFEQLSGVLDDTQPNAMVLETQFVNKNPQSTMKLAMARGIVLLAAAQRDILIFEYAPNVAKKAVVGKGHASKRQVQVMVSKILNVPEVLHPSNEDIADAFALAICHTHVARSPLCGVR

SEQ ID NO: 624 - protein, 323 aa, Chlamydia pneumoniae
  CPn0622
RYSVRLLSILKLHLFSLRSSSSLSPHYYHSCSRSMLHLLCRWKDADIMEWQQICNILSGVCSRMSGKLVSLQKETQDSCHQEHERIHLQYREQLSALEEEYRRREEAKNQDLEKLQQENTWLQNRLAEKLQQIRHQSDIIDEIKKELLQSVQRTEISEGRRLCYEHKIKQLEEQLQRYVSQHGAPSIEIEEDKSSAAYAEINRLKKSLIDLQQEKDIYIKTYHSEIAKLREKLQRQEGAQTSSEVCSIEKLTEVQTDLAEKKKAIALLQDIVEDQYCQLRDLHKEKGMAMPSNTKLDHLKGLLGKEPESEVDVVFSESKSLGS

SEQ ID NO: 625 - protein, 283 aa, Chlamydia pneumoniae
  CPn0623
IKGYNYVYFTRDPVIETVITSREGYKLSVRNTKHFSQDPFMVEAIEVISLGNICFFRNCDHSKPFLVPAGDYEVMEVRDTKINLKAVGLDRGVKIAGGREALIKLTKSTPLPVIDEKPLADSPEEGTEPTSPSKKEKKEARKDSFKGEKWKEKKKLSRRRNHKEIAEVTGASQEILDTVKEELWEESQENEIVEQKKFSLLPPPAKLISEVISQTVVDPVVTSADLNESLQALVRESSDLINALLSADDAIHFPETEEEPTSASFEESSAMFFPETSSATEEE

SEQ ID NO: 626 - protein, 336 aa, Chlamydia pneumoniae
  CPn0624
AMKVVINGFGRIGRLVLRQILKRNSSVEVLAINDLVPGDALTYLFKFDSTHGRFPEDVRCEADHLIVGKRKIQFLSERNVQNLPWKDLGVDLVIECTGLFTKKEDAEKHIQAGAKRVLISAPGKGDIPTFVMGVNHKTFNPEKDFVISNASCTTNCLAPIAKVLLDNFGITEGLMTTVHAATATQLVVDGPSKKDWRGGRGCLQNIIPASTGAAKAVTLCLPELKGKLTGMAFRVPIEDVSVVDLTVRLDKSTTYDDICKAMKQASETDLKGILDYTDEQVVSSDFIGSEYSSIFDALAGIALNDRFFKLVAWYDNETGYATRIVDLLEYVEKNSK

SEQ ID NO: 627 - protein, 143 aa, Chlamydia pneumoniae
  CPn0625
VMQHARKKFRVGRTSSHNRCMLANMLKSLIHYERIETTLPKAKELRRHADKMITLAKKNSLAARRIAIGRLMVRYNKLTSKEARQAKGGDTSVYNVDRLVVNKLFDELGNRFVERKGGYTRILKLQNRIGDNAQKCIIEFLAS

SEQ ID NO: 628 - protein, 392 aa, Chlamydia pneumoniae
  CPn0626
WLPAKKKAQSVVLGKEKGMSDNAHNLLYDKFELPEAVKMLPVEGLPIDKHARFIAEPLERGMGHTLGNALRRALLIGLEAPAIISFAMTGVLHEYMAIEGVIEDVTNIILNLKGALLKKYPMQDSSLGRTTQVLKASISIDASDLAAANGQKEVTLQDLLQEGDFEAVNPDQVIFTVTQPIQLEVVLRIAFGRGYTPSERIVLEDKGVYEIVLDAAFSPVTLVNYFVEDTRVGQDTDFDRLVLIVETDGRVTPKEALAFSTQILTKHFSIFENMDEKKIVFEEAISIEKENKDDILHKLILGINEIELSVRSTNCLSNANIETIGELVIMPEPRLLQFRNFGKKSLCEIKNKLKEMKLELGMDLTQFGVGLDNVKEKMKWYAEKIRAKNTKG

SEQ ID NO: 629 - protein, 140 aa, Chlamydia pneumoniae
  CPn0627
FLIRSRVLVKNQAQAKKSVKRKQLKNIPSGVVHVKATFNNTIVSITDPAGNVISWASAGKVGYSGSRKSSAFAATVAAQDAAKTAMNSGLKEVEVCLKGTGAGRESAVRALISAGLVVSVIRDETPVPHNGCRPRKRRRV

SEQ ID NO: 630 - protein, 133 aa, Chlamydia pneumoniae
  CPn0628
DAYTILREAQRMPRIIGIDIPAKKKLKISLTYIYGIGSARSDEIIKKLKLDPEARASELTEEEVGRLNSLLQSEYTVEGDLRRRVQSDIKRLIAIHSYRGQRHRLSLPVRGQRTKTNSRTRKGKRKTVAGKKK

SEQ ID NO: 631 - protein, 465 aa, Chlamydia pneumoniae
  CPn0629
KIRLFRPYMTTLRQFFLITELRQKLFYTFALLTACRVGVFIPVPGINGELAVAYFKQLLGSGQNLFQLADIFSGGAFAQMTVIALGVVPYISASIIVQLFLVFMPALQREMRESSDQGKRRIGRLTRLFTVALAVIQSLLFAKFALRMNLTIPGIVLPTLLSSKLFGVPWIFYITTVVVMTTGTLLLMWIGEQISDKGIGNGISLIIALGILSSFPSVLGSIVNKLNLGSQDSSDLGLISILILALVFVFVLITTILIIEGVRKIPVQYARRVIGRREVPGGGSYLPLKVNYAGVIPVIFASSLLMFPATIGQFIASESSWMKRIAALLAPGSLVYSICYVLLIIFFTYFWTATQFHPEQIASEMKKNNAFIPGIRQGKPTQHYLEYTMNRVTLLGALFLAAIAILPSLLGCLLRVDSNVSYFLGGTAMLIVVGVVLDTMKQVDAFLLMRRYDSVLKTDRTKGRH

SEQ ID NO: 632 - protein, 144 aa, Chlamydia pneumoniae
  CPn0630
MIKLESLFDISERKRRKKLLGRGPSSGHGKTSGRGHKGDGSRSGYKRRFGYEGGGVPLYRRVPTRGFSHKRFDKCVEEITTGRLAELFQEGEAITLDALKAKKAIARQAVRVKVILKGDLEKTFVWQDTAVVLSQGVQNLLGIT

SEQ ID NO: 633 - protein, 167 aa, Chlamydia pneumoniae
  CPn0631
EEMSLSKNSHKEDQLEEKVLVVNRCSKVVKGGRKFSFSALILVGDGKGRLGYGFAKANELTDAIRKGGEAAKKNLMKIEALEDGSIPHEVLVHHDGAQLLLKPAKPGTGIVAGSRIRLILEMAGIKDIVAKSFGSNNPMNQVKAAFKALTGLSPRKDLLRRGAAIND

SEQ ID NO: 634 - protein, 176 aa, Chlamydia pneumoniae
  CPn0632
KGLISSWLVNLLQVFAPNVLLNLIKVREFVMKMNMSVVKLVKLRKQAKNRSRVMESSLCKKSLMKRRRALRVRKVLKGSPTKPRLSVVKTNKHIYVQLIDDSIGKTLASVSTLSKLNKSQGLTKKNQEVAKVLGTQIAELGKNLQLDRVVFDRGPFKYHGIVSMVADGAREGGLQF

SEQ ID NO: 635 - protein, 184 aa, Chlamydia pneumoniae
  CPn0633
SMSRKAREPILLPQGVEVSIQDDKIIVKGPKGSLTQKSVKEVEITLKDNSIFVHAAPHVVDRPSCMQGLYWALISNMVQGVHLGFEKRLEMIGVGFRASVQGAFLDLSIGVSHPTKIPIPSTLQVSVEKNTLISVKGLDKQLVGEFAASIRAKRPPEPYKGKGIRYENEYVRRKAGKAAKTGKK

SEQ ID NO: 636 - protein, 143 aa, Chlamydia pneumoniae
  CPn0634
ESSIKRKRIYMGMTSDSIADLLTRIRNALMAEHLYVDVEHSKMREAIVKILKHKGFVAHYLVKEENRKRAMRVFLQYSDDRKPVIHQLKRVSKPSRRVYVSAAKIPYVFGNMGISVLSTSQGVMEGSLARSKNIGGELLCLVW

SEQ ID NO: 637 - protein, 186 aa, Chlamydia pneumoniae
  CPn0635
GERKANMSRLKKFYTEEIRKSLFEKFGYANKMQIPVLKKIVLSMGLAEAAKDKNLFQAHLEELTMISGQKPLVTKARNSIAGFKLREGQGIGAKVTLRGIRMYDFMDRFCNIVSPRIRDFRGFSNKGDGRGCYSVGLDDQQIFPEINLDRVKRTQGLNITWVTTAQTDDECTTLLELMGLRFKKAQ

SEQ ID NO: 638 - protein, 117 aa, Chlamydia pneumoniae
  CPn0636
FKEKEVMKKQNIRVGDKVFILAGNDKGKEGKVLSLTEDKVVVEGVNVRIKNIKRSQQNPKGKRISIEAPIHISNVRLTIAGEPAKLSVKVTEQGRELWQRRPDGTSQLYRLVRGKKG

SEQ ID NO: 639 - protein, 125 aa, Chlamydia pneumoniae
  CPn0637
IEIMIQQESQLKVADNTGAKKVKCFKVLGGSRRRYATVGDVIVCSVRDVEPNSSIKKGDVIKAVIVRTRRHITRKDGSTLKFDTNSCVIIDDKGNPKGTRIFGPVAREIRDRGFIKISSLAPEVI

SEQ ID NO: 640 - protein, 94 aa, Chlamydia pneumoniae
  CPn0638
NKKEKVKSMASEPRGSRKVKIGVVVSAKMEKTVVVRVERIFSHPQYLKVVRSSKKYYAHTELKVSEGDKVKIQETRPLSKLKRWRVIEHVGVVS

SEQ ID NO: 641 - protein, 79 aa, Chlamydia pneumoniae
  CPn0639
ASGKGINMAAKKDLLTQLRGKSDDDLDAYVHENKKALFALRAENLLQNKVVKVHMFSTHKKNIARALTVKQERKGKVHG

SEQ ID NO: 642 - protein, 140 aa, Chlamydia pneumoniae
  CPn0640
IIMLMPKRTKFRKQQKGQFAGLSKGATFVDFGEYAMQTLERGWVTSRQIEACRVAINRYLKRRGKVWIRIFPDKSVTKKPAETRMGKGKGAPDHWVAVVRPGRILFEVANVSKEDAQDALRRAAAKLGIKTRFVKRVERV

SEQ ID NO: 643 - protein, 228 aa, Chlamydia pneumoniae
  CPn0641
KGRRIMGQKGCPIGFRTGVTKRWRSLWYGNKQEFGKFLIEDVRIRQFLRKKPSCQGAAGFVVRRMSGKIEVTIQTARPGLVIGKKGAEVDLLKEELRALTGKEVWLEIAEIKRPELNAKLVADNIARQIERRVSFRRAMKKAMQSVMDAGAVGVKIQVSGRLAGAEIARSEWYKNGRVPLHTLRADIDYATACAETTYGIIGIKVWINLGENSSSTTPNNPAAPSAAA

SEQ ID NO: 644 - protein, 115 aa, Chlamydia pneumoniae
  CPn0642
RRHSMFKATARYIRVQPRKARLAAGLMRNLSVQEAEEQLGFSQLKAGRCLKKVLNSAVANAELHENIKRENLSVTEVRVDAGPVYKRSKSKSRGGRSPILKRTSHLTVIVGEKER

SEQ ID NO: 645 - protein, 92 aa, Chlamydia pneumoniae
  CPn0643
EIRIMGRSLRKGPFVDHHLLKKVRAMNIEEKKTPIKTWSRRSMITPEMIGHTFEVHNGKKFLTVFVSETMVGHKLGEFSPTRIFKSHPVKKG

SEQ ID NO: 646 - protein, 291 aa, Chlamydia pneumoniae
  CPn0644
FIREINSMFKKFKPVTPGTRQLVLPAFDELTTRGELRGTKSKRSLRPNKKLSFFKKSSGGRDNLGHISCRHRGGGAKQLYRVVDFKRNKDGITAKVVTVEYDPNRSAYIALLSYEDGEKRYILAPKGIQRGDVVVSGEGSPFKPGCCMTLKSIPLGLSVHNIEMRPSSGGKLVRSAGLAAQVIAKSPGYVTLKMPSGEFRMLNEGCRATIGEVSNADHNLRVDGKAGRRRWMGVRPTVRGTAMNPVDHPHGGGEGRHNGYIPRTPWGKVTKGLKTRDKNKSNKWIVKDRRK

SEQ ID NO: 647 - protein, 112 aa, Chlamydia pneumoniae
  CPn0645
DMKDPYDVIKRHYVTEKAKMLEHLSAGTGEGKKKGSFCKDPKFVFIVSHDATKPLIAQALEAIYVDKNVKVKSVNTINVKPQPARMFRGRRKGKTSGFKKAIVTFYQGHSVG

SEQ ID NO: 648 - protein, 229 aa, Chlamydia pneumoniae
  CPn0646
YREDLMVLLSKFDFSGNKIGEVEVADSLFADEGDGLQLIKDYIVAIRANKRQWSACTRNRSEVSHSTKKPFKQKGTGNARQGCLASPQFRGGGIVFGPKPKFNQHVRINRKERKAAIRLLLAQKIQTNKLTVVDDTVFVDALTAPKTQSALRFLKDCNVECRSILFIDHLDHVEKNENLRLSLRNLTAVKGFVYGININGYDLASAHNIVISKKALQELVERLVSETKD

SEQ ID NO: 649 - protein, 278 aa, Chlamydia pneumoniae
  CPn0647
YLEYFSYCKNLPPLITCPFIFLRENFLFFLENSISKILSRFVSLFLQEESKSLLLMDKFMRSHISVMGKKEGMIHIFDKDGSLVACSVIRVEPNVVTQIKTKESDGYFSLQIGAEEMNAPAHTITKRVSKPKLGHLRKAGGRVFRFLKEVRGSEEALNGVSLGDAFGLEVFEDVSSVDVRGISKGKGFQGVMKKFGFRGGPGSHGSGFHRHAGSIGMRSTPGRCFPGSKRPSHMGAENVTVKNLEVIKVDLEKKVLLVKGAIPGARGSIVIVKHSSRT

SEQ ID NO: 650 - protein, 344 aa, Chlamydia pneumoniae
  CPn0648
FFFKKPCKEVKMATNAIRSAGSAASKMLLPVAKEPAAVSSFAQKGIYCIQQFFTNPGNKLAKFVGATKSLDKCFKLSKAVSDCVVGSLEEAGCTGDALTSARNAQGMLKTTREVVALANVLNGAVPSIVNSTQRCYQYTRQAFELGSKTKERKTPGEYSKMLLTRGDYLLAASREACTAVGATTYSATFGVLRPLMLINKLTAKPFLDKATVGNFGTAVAGIMTINHMAGVAGAVGGIALEQKLFKRAKESLYNERCALENQQSQLSGDVILSAERALRKEHVATLKRNVLTLLEKALELVVDGVKLIPLPITVACSAAISGALTAASAGIGLYSIWQKTKSGK

SEQ ID NO: 651 - protein, 321 aa, Chlamydia pneumoniae
  CPn0649
LNLKVVYFGTPTFAATVLQDLLHHKIQITAVVTRVDKPQKRSAQLIPSPVKTIALTHGLPLLQPSKASDPQFIEELRAFNADVFIVVAYGAILRQIVLDIPRYGCYNLHAGLLPAYRGAAPIQRCIMEGATESGNTVIRMDAGMDTGDMANITRVPIGPDMTSGELADALASQGAEVLIKTLQQIESGQLQLVSQDAALATIAPKLSKEEGQVPWDKPAKEAYAHIRGVTPAPGAWTLFSFSEKAPKRLMIRKASLLAEAGRYGAPGTVVVTDRQELAIACSEGAICLHEVQVEGKGSTNSKSFLNGYPAKKLKIVFTLNN

SEQ ID NO: 652 - protein, 283 aa, Chlamydia pneumoniae
  CPn0650
SRRNMASIHPTAIIEPGAKIGKDVVIEPYVVIKATVTLCDNVVVKSYAYIDGNTTIGKGTTIWPSAMIGNKPQDLKYQGEKTYVTIGENCEIREFAIITSSTFEGTTVSIGNNCLIMPWAHVAHNCTIGNNVVLSNHAQLAGHVQVGDYAILGGMVGVHQFVRIGAHAMVGALSGIRRDVPPYTIGSGNPYQLAGINKVGLQRRQVPFATRLALIKAFKKIYRADGCFFESLEETLEEYGDIPEVKNFIEFCQSPSKRGIERSIDKQALEEESADKEGVLIES

SEQ ID NO: 653 - protein, 153 aa, Chlamydia pneumoniae
  CPn0651
MNQPSVIKLRELLDLLPHRYPFLLVDKVLSYDIEARSITAQKNVTINEPFFMGHFPNAPIMPGVLILEALAQAAGVLIGLVLENDRNKRIALFLGIQKAKFRQAVRPGDVLTLQADFSLISSKGGKAWAQARVDSQLVTEAELSFALVDKESI

SEQ ID NO: 654 - protein, 297 aa, Chlamydia pneumoniae
  CPn0652
KRNSIIYGDSLSGFYMLERTQRTLKREVRYSGVGIHLGKSSTLHLQPAQTNTGIVFQRQSASGNYENVPALLDHVYTTGRSTTLSRGSAVIATVEHLMAALRSNNIDNLIIQCSGEEIPIGDGSSNVFVELIDQAGICEQEDKVSIARLTRPVYYQHQDIFLAAFPSDELKISYTLHYPQSSTIGTQYKSLVINEESFRQEIAPCRTFALYNELCFLMEKGLIGGGCLDNAVVFKDDGIISRGQLRFADEPVRHKILDLIGDLSLVGRPFVAHVLAVGSGHSSNIAFGKKILEALEL

SEQ ID NO: 655 - protein, 544 aa, Chlamydia pneumoniae
  CPn0653
GEPVLRIFCFVISWCLIAFAQPDLSGFVSILGAACGYGFFWYSLEPLKKPSLPLRTLFVSCFFWIFTIEGIHFSWMLSDQYIGKLIYLVWLTLITILSVLFSGFSCLLVAIVRQKRTAFLWSLPGVWVAIEMLRFYGIFSGMSFDYLGWPMTASAYGRQFGGFLGWAGQSFAVIAVNMSFYCLLLKKPHAKMLWVLTLLLPYTFGAIHYEYLKHAFQQDKRALRVAVVQPAHPPIRPKLKSPIVVWEQLLQLVSPIQQPIDLLIFPEVVVPFGKHRQVYPYESCAHLLSSFAPLPEGKAFLSNSDCATALSQHFQCPVIIGLERWVKKENVLYWYNSAEVISHKGISVGYDKRILVPGGEYIPGGKFGSLICRQLFPKYALGCKRLPGRRSGVVQVRGLPRIGITICYEETFGYRLQSYKRQGAELLVNLTNDGWYPESRLPKVHFLHGMLRNQEFGMPCVRACQTGVTAAVDSLGRILKILPYDTRETKAPSGVLETSLPLFNYKTLYGYCGDYPMILIAFCAVSYLGGGFLGYRLLAKKEIR

SEQ ID NO: 656 - protein, 183 aa, Chlamydia pneumoniae
  CPn0654
KKIIDFLSVDRYYRNQEYPIKILSVESTMLKKKPVSFSCIDGHIYKIFPNDLNANNTVFGGLLMSLLDRLALVVAERHTESVCVTAFVDALRFYAPAYMGENLICKAAVNRTWRTSLEVGVKVWAENIYKQERRHITSAYFTFVAVNEDNQPIPVHQIVPETPEEKRRYNEADRRRQARLELK

SEQ ID NO: 657 - protein, 252 aa, Chlamydia pneumoniae
  CPn0655
KEIMSLLKDTVFTCLDCEMTGLDVKKDRIIEIAAVRFTFDSVISSIEFLINPERVVSAESQRVHHISNAMLRDQPKIAEVFPQIKAFFKEGDYIVGHSVGFDLQVLAQEMERIGETFLSKYTIIDTLRLAKEYGDSPNNSLESLAVHFNVPYDGNHRAMKDVEININIFKHLCKRFRTLEQLKQVLAKPIKMKYMPLGKHKGRCFSEIPLAYLQWASKMDFDSDLLFSIRHEIKHRQKGTGFSQVNNPFMEL

SEQ ID NO: 658 - protein, 69 aa, Chlamydia pneumoniae
  CPn0656
THNFLLLPLSLFDILLTVEGFLCLTLYFASVQRMPCEQKRVPGNLYYYYIAAHSSLCLSVCKDTMENKD

SEQ ID NO: 659 - protein, 142 aa, Chlamydia pneumoniae
  CPn0657
PMGRYRRVSHSSQETLLLGTELGQVLVPGAVLLLFGDYGAGKTEFVRGIVSGYLGDTIAEEVASPSFSILHVYGNEPKRLCHYDLYRIDQKNQEYIFQDAEEDDVLCIEWADRLPKPRFCDTINIYITMQTNMEREIIIEKR

SEQ ID NO: 660 - protein, 242 aa, Chlamydia pneumoniae
  CPn0658
KRVGMDISGAVKQKLLQFLGKQKKPELLATYLFYLEQALSLRPVVFVRDKIIFKTPEDAVRILEQDKKIWRETEIQISSEKPQVNENTKRIYICPFTGKVFADNVYANPQDAIYDWLSSCPQNMEKQGGVRIKRFLVSEDPDVIKEYAVPPKEPIIKTVFASAITGKLFHSLPPLLEDFISSYLRPMTLEEVQNQTKFQLESSFLSLLQDALVEDKIAAFIESLADDTAFHVYISQWVDTEE

SEQ ID NO: 661 - protein, 120 aa, Chlamydia pneumoniae
  CPn0659
LQENNRDSNSIFFREGKLMVKIISSENFDSFIASGLVLVDFFAEWCGPCRMLTPILENLAAELPHVTIGKINIDENSKPAETYEVSSIPTLILFKDGNEVARVVGLKDKEFLTNLINKHA

SEQ ID NO: 662 - protein, 156 aa, Chlamydia pneumoniae
  CPn0660
MRVVLHCPDIPQNTGNIGRTCVALGAELILVRPLGFSLADKFVKRAGMDYWDKLQLTVVDSIEEALHDVPEDQIFCLSTKGSASYTEFSLPSSGTYVFGSESKGLPKEILKKYYKNCLRIPMQQDIRSLNLATSVGIVLYEVVRQKTVALQKNPTV

SEQ ID NO: 663 - protein, 271 aa, Chlamydia pneumoniae
  CPn0661
HSRCLKIKDRRRKMNRRWNLVLATVALALSVASCDVRSKDKDKDQGSLVEYKDNKDTNDIELSDNQKLSRTFGHLLARQLRKSEDMFFDIAEVAKGLQAELVCKSAPLTETEYEEKMAEVQKLVFEKKSKENLSLAEKFLKENSKNAGVVEVQPSKLQYKIIKEGAGKAISGKPSALLHYKGSFINGQVFSSSEGNNEPILLPLGQTIPGFALGMQGMKEGETRVLYIHPDLAYGTAGQLPPNSLLIFEINLIQASADEVAAVPQEGNQGE

SEQ ID NO: 664 - protein, 589 aa, Chlamydia pneumoniae
  CPn0662
SKGCYMKYRTHRCNELTSNHIGENVQLAGWVHRYRNHGGVVFIDLRDRFGITQIVCREDEQPELHQRLDAVRSEWVLSVRGKVCPRLAGMENPNLATGHIEVEVASFEVLSKSQNLPFSIADDHINVNEELRLEYRYLDMRRGDIIEKLLCRHQVMLACRNFMDAQGFTEIVTPVLGKSTPEGARDYLVPSRIYPGKFYALPQSPQLFKQLLMVGGLDRYFQIATCFRDEDLRADRQPEFAQIDIEMSFGDTQDLLPIIEQLVATLFATQGIEIPLPLAKMTYQEAKDSYGTDKPDLRFDLKLKDCRDYAKRSSFSIFLDQLAHGGTIKGFCVPGGATMSRKQLDGYTEFVKRYGAMGLVWIKNQEGKVASNIAKFMDEEVFHELFAYFDAKDQDILLLIAAPESVANQSLDHLRRLIAKERELYSDNQYNFVWITDFPLFSLEDGKIVAEHHPFTAPLEEDIPLLETDPLAVRSSSYDLVLNGYEIASGSQRIHNPDLQSQIFTILKISPESIQEKFGFFIKALSFGTPPHLGIALGLDRLVMVLTAAESIREVIAFPKTQKASDLMMNAPSEIMSSQLKELSIKVAF

SEQ ID NO: 665 - protein, 440 aa, Chlamydia pneumoniae
  CPn0663
KSNHFERRHHVTVTLPKGVFDIFPYLADAKQLWRHTSLWHSVEKAIHTVCMLYGFCEIRTPIFEKSEVFLHVGEESDVVKKEVYSFLDRKGRSMTLRPEGTAAVVRSFLEHGASHRSDNKFYYILPMFRYERQQAGRYRQHHQFGVEAIGVRHPLRDAEVLALLWDFYSRVGLQHMQIQLNFLGGSETRFRYDKVLRAYLKESMGELSALSQQRFSTNVLRILDSKEPEDQEIIRQAPPILDYVSDEDLKYFNEILDALRVLEIPYAINPRLVRGLDYYSDLVFEATTTFQEVSYALGGGGRYDGLISAFGGASLPACGFGVGLERAIQTLLAQKRIEPQFPHKLRLIPMEPDADQFCLEWSQHLRRLGIPTEVDWSHKKVKGALKAASTEQVSFVCLIGERELISQQLVIKNMSLRKEFFGTKEEVEQRLLYEIQNTPL

SEQ ID NO: 666 - protein, 73 aa, Chlamydia pneumoniae
  CPn0664
LWEAHAMKKLIALIGIFLVPIKGNTNKEHDAHATVLKAARAKYNLFFVQDVFPVHEVIEPISPDCLVHYEGWV

SEQ ID NO: 667 - protein, 456 aa, Chlamydia pneumoniae
  CPn0665
KMNVWTKFFQPPKHIKEIEDQEVVKKKYKYWRIRIFYSMFIGYIFYYFTRKSFTFAMPTLIADLGFDKAQLGIIGSTLYFSYGISKFVSGVMSDQSNPRYFMAIGLMITGLTNIFFGMSSSIVLFALWWGLNGWFQGWGWPPCARLLTHWYAKSERGTWWSVWSTSHNIGGALIPILTGFIIDYSGWRGAMYVPGILCIGMGLVLINRLRDTPQSLGLPPIEKYKRDPHHAHHEGKSASEGTEEIERELSTREILFTYVLTNQWLWFLAAASFFIYIVRMAVNDWSALFLIETKHYAAVKANFCVSLFEIGGLFGMLVAGWLSDKISKGNRGPMNVLFSLGLLFAILGMWFSRSHNQWWVDGTLLFVIGFFLYGPQMMIGLAAAELSHKKAAGTASGFTGWFAYFGATFAGYPLGKVTDVWGWKGFFIALLACASIALLLFLPTWNATEKNTRSKA

SEQ ID NO: 668 - protein, 1243 aa, Chlamydia pneumoniae
  CPn0666
GFFLTWIPLHCHSQYSVLDAMSSIKDFVAKGQEFGIPALALTDHGNLYGAVDFYKECTQKGIQPIIGCECYIAPGSRFDKKKEKRSRAAHHLILLCKNEQGYRNLCILTSLAFTEGFYYFPRIDKDLLRQYSEGLICLSGCLSSSVSDAALKSPEALLLELQWFQDLFKDDYFTEVQLHKMSEESIAGFKEEWLKQEYYSLIEKQIKVNTAVLEASKRLGIPTVATNDIHYINANDWQAHEILLNVQSGETVRIAKQNTHIPNPKRKVYRSREYYFKSPAQMAELFKDIPEVISNTLEVAKRCDFTFDFSKKHYPIYVPESLKTLNSYTEEDRYQASAVFLKQLAEEALPKKYSSEVLAHIAKKFPHRDPIDIVKERMDMEMAIIIPKGMCDYLLIVWDIIHWAKANGIPVGPGRGSGAGSVLLFLLGITEIEPIRFDLFFERFINPERLSYPDIDIDICMAGRERVINYAIERHGKDNVAQIITFGTMKAKMAVKDVGRTLDMALSKVNHIAKHIPDLNTTLSKALETDPDLHQLYINDAESAQVIDMALCLEGSIRNTGVHAAGVIICGDQLTNHIPICISKDSTMITTQYSMKPVESVGMLKVDLLGLKTLTSINIAMSAIEKKTGQSLAMATLPLDDATTFSLLHQGKTMGIFQMESKGMQELAKNLRPDLFEEIIAMGALYRPGPMDMIPSFINRKHGKEIIEYDHPLMESILKETYGIMVYQEQVMQIAGALASYSLGEGDVLRRAMGKKDFQQMEQEREKFCKRACNNGIDPELATVIFDKMEKFAAYGFNKSHAAAYGLITYTTAYLKANYPKEWLAALLTCDSDDIEKIGKLIREAQSMGIPILPPHINVSSNHFVATDEGIRFAMGAIKGIGRGLIESIVEERDHHGPYESIRDFIQRSDLKKVSKKSIESLIDAGCFDCFDSNRDLLLASVEPLYEAIAKDKKEAASGVMTFFTLGAMDRKNEVPICLPKDIPTRSKKELLKKEKELLGIYLTEHPMDTVRDHLSRLSVVLAGEFENLPHGSVVRTVFIIDKVTTKISSKAQKKFAVLRVSDGIDSYELPIWPDMYEEQQELLEEDRLIYAILVLDKRSDSLRISCRWMKDLSIVNENIIYECDQAFDRIKNQVQKMSFTMSTSGKETKAKGNKPNENGHTQALAPVTLSLDLNELRHSHLCILKKIVQKHPGSRTLVLVFTQDNERVASMSPDDAYFVCEDIEELRQELVTADLPVRVITV

SEQ ID NO: 669 - protein, 307 aa, Chlamydia pneumoniae
  CPn0667
NISLLCKIQKRYFMKKLILYFAAFVASLFCGVFLWDRVPCAQKIMRLAADHSSEVFSKSCRFVRKISGFEELQVFERHVSPEQALALFPEYRDGKSFVELAFIPHTLMHVRFSKEEPVKKHIISQEGEILWSLVNGEMVLHTGTWTCSKGFRECLLLHAGKQDMRVIQTLATLGGTTSRESLAQALALKNIRAERVIKECQKKKLIFASGNQIGTHFQQFQPIRGCTTTLNNNPVWLQKPRHAAVFPAQYSEDRVRHLVKMIFGDNFLIVRSSMVYVPVYKISLVSADNSVRVEYINAVTGKSFQDL

SEQ ID NO: 670 - protein, 329 aa, Chlamydia pneumoniae
  CPn0668
WRFVVVSPRLIMKFLLYVPLLLVLVSTGCDAKPVSFEPFSGKLSTQRFEPQHSAEEYFSQGQEFLKKGNFRKALLCFGIITHHFPRDILRNQAQYLIGVCYFTQDHPDLADKAFASYLQLPDAEYSEELFQMKYAIAQRFAQGKRKRICRLEGFPKLMNADEDALRIYDEILTAFPSKDLGAQALYSKAALLIVKNDLTEATKTLKKLTLQFPLHILSSEAFVRLSEIYLQQAKKEPHNLQYLHFAKLNEEAMKKQHPNHPLNEVVSANVGAMREHYARGLYATGRFYEKKKKAEAANIYYRTAITNYPDTLLVAKCQKRLDRISKHTS

SEQ ID NO: 671 - protein, 212 aa, Chlamydia pneumoniae
  CPn0669
IEYLSILPKIEINMRLFSLGTIYLFFSLALSSCCGYSILNSPYHLSSLGKSLLQERIFIAPIKEDPHGQLCSALTYELSKRSFAISGRSSCAGYTLKVELLNGIDKNIGFTYAPNKLGDKTHRHFIVSNEGRLSLSAKVQLINNDTQEVLIDQCVARESVDFDFEPDLGTANAHEFALGQFEMHSEAIKSARRILSIRLAETIAQQVYYDLF

SEQ ID NO: 672 - protein, 153 aa, Chlamydia pneumoniae
  CPn0670
PRRLLNRYTMTFFEGETVFPAVLSELHSMLDLIKRAGKQSKCPQEKLLKLELACEELLVNIISYAYQGENSPGTIAISCISHRGDLEVVIKDHGPSFNPLAVSINIQEDLPLEQRKLGGLGIFLAKSSVDEFLYAREDHCNIVHLKMLNGQHS

SEQ ID NO: 673 - protein, 152 aa, Chlamydia pneumoniae
  CPn0671
RITINQRKYTMSLDFFEEFYHQSILNTGTSFPEGYLNIAEILSYPHCTDANTDFLCSQSDNDFIIAESKDKLTLFNADFAIWLVPELVQGQAVTRGYIAVSQGEGNYEPEMAFEASGQYNQSSLILEALQLYLKDIKDTENALRSFRFNNDH

SEQ ID NO: 674 - protein, 442 aa, Chlamydia pneumoniae
  CPn0672
TIKSPHMKRPFFTYLCIIFYGSCASLSLHAGLSFPEVRGATAAVVHADSGKVFYDKDIDAVIYPASMTKIATALFILKHYPTVLDTLIKVKQDAIASITPQAKKQSGYRSPPHWLETDGSTIQLHLREELLGWDLFHALLVCSANDAANVLAMACCGSVEKFMDKLNFFLKEEIGCTHTHFNNPHGLHHPNHYTTTRDLISIMRCALKEPPFRGVISTTSYKIGATNLHGERILSPTNKLLLPGSTYHYPPALGGKTGTTKTAGKNLIMAAEKNNRLLVTIATGYSGPVSDLYQDVIALCETVFNEPLLRKELVPPSDCLQLEIANLGKLSCPLPEGLYYDFYASEDREPLSVSFIAHADAFPIEQGDLLGHWVFYDDEGKKISSQPFYAPCRFERTIKPWKLYMKRVFTSYRTYMSITMLLMYFRIRKHRKYKNLKHYSKI

SEQ ID NO: 675 - protein, 74 aa, Chlamydia pneumoniae
  CPn0673
GKSTEGKAYHCFLKQVSIALNREEVWDNPHHLMFILMQFQQFSGEQDRFGSFLEATIRDRVSFLVLQEKIATLK

SEQ ID NO: 676 - protein, 371 aa, Chlamydia pneumoniae
  CPn0674
RGILYVTMVPFRQHHAYQLLKQLHTSAISEADRVSYYFKQNRSLGSKDRQWIQNIIFNILRHRRLLETLILDSGEQVTPEALVAKVNEGVLENLDSYSAIPWPVRYSISDDLAHFLVQDYGEEQAEEIAKIWLTEAPITIRVNTDKISVKELQEKLEYPSSPGELPEALHFSKRHPLQSTEAFRRGFFEIQDENSQRISQGISLTDKDIVLDFCAGAGGKSLIFAQKAKHVVINDSRKAILQTAKHRLLRAGARNFSLADQLRLGSFSVVIVDAPCSGTGVFRRHPEHKWQFSKKLLLNYVRVQKSILKQASAYVGPRGRLVYITCSLLKEENEAHVAYMHSLGWKEVHRKTLPLQVGKGDAFFTSHFQKI

SEQ ID NO: 677 - protein, 388 aa, Chlamydia pneumoniae
  CPn0675
VPLSMILDFQFSIGYYLRVLELAIRDGTRILAYDRKRLLLDAWPVNDPLPTNYDTSVSTIRQVIHELFSWSAISYSISSRLLAIIELRLHEEKPQTGWLYRLFFPSKYHIKKAIVDKLCMFKSLILFESKRPVDKIVQAANKVFSKGKSNFSSWEDFTHEVTVSEVQTPLAGEVQRRLAADASLQMIIEALTTLLEGHTAYLPLSLELLNQFIGEKAQPLKTLSEKSYVLLRELIQLFSLSAEDFQTIIMSIISDSLSEVLANSLIGNQPLTFHGKTFVGLWQETALASPEDSKLALGFLAEVLRKVIVEKKLHVSKSDNTTPEEVGNIYSIRDQNPALWDKMITMLLMRWLLDYDRDIGIALRKAAEYYNPHPSFWRQFLRLWQRRP

SEQ ID NO: 678 - protein, 390 aa, Chlamydia pneumoniae
  CPn0676
SMGTPISGNDGDRNTISDPLEESAAEEGDSDLEDRVSESATQVIETIADTGIPEATPSEGTNSDLNSDLVDRVEYEARGSLLTTMLARIRKAVSQIWMHVKTKRHPKEQGVRSLGDIPCDLLKATRLPKETAEPPYFYALETALASCRSFFFHVFLRLFTLLRRQHPEAPLDLCGTDPISPEAAVAFALILRSCCKWVATDAVQEGLPLEVIEEAGMYNAFSLEATTTVEEVSKRLSELLYSDKRIDGLANVRGITKIITSPYLGAGQCVSVVDNLKTYDLGRNYTQVLACASQIDEFADKGENEALVMKDILYLVRQDRSKELGDFLMMWSEEHASEVNYDVVLAILEVNLPILEEDYRSHPLAYQKKLNYVICQFFCSERLTSIEPKD

SEQ ID NO: 679 - protein, 385 aa, Chlamydia pneumoniae
  CPn0677
RIAMGINPSGNRSPDDVWVRGAQGDSSSTQGTGATNSNLGAHNVTTSTSQPQVASKAKQLWQTVREFFLGKKSPDSSQGASGPAMQSPSGPTIRPTRPAPPPPTTGGANAKRPATHGKGRAPQPPTAGSSSGSEQPTAMSSEVAKLVSELKDAVHSHAESQKVLKKVSQELQTKWTDWENNRGPDYLLHGYRVIARALQQTYTEQSMLIEGTSSTGPVPQAVTVAKDAVTQTVRGAIKNLENPKPGNDPDGVLMQVVISLGIEGPTLDPGESIQNFLETRVSDFGGDDSDIDYTSDIARLGSALDRVRENHPNEMPRIWIALARELGAAVHSHATSVRIANAGKNHTRDVVRMANESSRLLQGMKVLSVGAWANTMTVLIGDLFE

SEQ ID NO: 680 - protein, 216 aa, Chlamydia pneumoniae
  CPn0678
KIIMSVNPSGNSKNDLWITGAHDQHPDVKESGVTSANLGSHRVTASGGRQGLLARIKEAVTGFFSRMSFFRSGAPRGSQQPSAPSADTVRSPLPGGDARATEGAGRNLIKKGYQPGMKVTIPQVPGGGAQRSSGSTTLKPTRPAPPPPKTGGTNAKRPATHGKGPAPQPPKTGGTNAKRAATHGKGPAPQPPKGILKQPGQSGTSGKKRVSWSDED

SEQ ID NO: 681 - protein, 404 aa, Chlamydia pneumoniae
  CPn0679
GYMDKLTVQDLSPEEKKVLVRVDFNVPMQDGKILDDIRIRSAMPTINYLLKKHAAVILMSHLGRPKGQGFQEEYSLQPVVDVLEGYLGHHVPLAPDCVGEVARQAVAQLSPGRVLLLENLRFHIGEEHPEKDPTFAAELSSYGDFYVNDAFGTSHRKHASVYVVPQAFPGRAAAGLLMEKELEFLGRHLLTSPKRPFTAILGGAKISSKIGVIEALLNQVDYLLLAGGMGFTFLQALGKSLGNSLVEKSALDLARNVLKIAKSRNVTIVLPSDVKAAENLQSKEYSVISIDQGIPPHLQGFDIGPRTTEEFIRIINQSATVFWNGPVGVYEVPPFDSGSIAIANALGNHPSAVTVVGGGDAAAVVALAGCSTKVSHVSTGGGASLEFLEQGFLPGTEVLSPSKS

SEQ ID NO: 682 - protein, 428 aa, Chlamydia pneumoniae
  CPn0680
YSMLPLIIFVLLCGFYTSWNIGANDVANAVGPSVGSGVLTLRQAVVIAAIFEFFGALLLGDRVAGTIESSIVSVTNPMIASGDYMYGMTAALLATGVWLQLASFFGWPVSTTHSIVGAVIGFGLVLGKGTIIYWNSVGIILISWILSPFMGGCVAYLIFSFIRRHIFYKNDPVLAMVRVAPFLAALVIMTLGTVMISGGVILKVSSTPWAVSGVLVCGLLSYIITFYYVHTKHCSYISDTPKKGSLTYRLKERGGNYGRKYLVVERIFAYLQIIVACFMAFAHGSNDVANAIAPVAGVLRQAYPASYTSYTLIRLMAFGGIGLVIGLAIWGWRVIETVGCKITELTPSRGFSVGMGSALTIALASILGLPISTTHVVVGAVLGIGLARGIRAINLNIIKDIVLSWFITLPAGALLSILFFFALRALFH

SEQ ID NO: 683 - protein, 248 aa, Chlamydia pneumoniae
  CPn0681
NGIRSHKSFTRSFRQVIIAKKAILMQTLARLFGQSPFAPLQAHLEMVVSCVEYMLPIFTALRDGRYEELLEMAKLVSDKEYQADCIKNDMRNHLPAGLFMPISRAGILEIISIQDSIADTAEDVAILLTIRRLNFYPSMETLFFRFLEKNLEAFELTMTLLHEFNQLLESSFGGRKADKARLLVGRVAKSEHESDVLQRELMQIFFSDDFIIPEKEFYLWLQVIRRTAGISDSSEKLAHRINMTLEEK

SEQ ID NO: 684 - protein, 348 aa, Chlamydia pneumoniae
  CPn0682
TSKGLHKNSLFRNNNLPKRSCKRLMASNPILQIEDLSITLAKQRQQYPIVQSLSFTINEGQTLAIIGESGSGKSVSAHAILRLLPCPPFSVSGQVNFQGHNLLTASRSIQKKIIGTEISMIFQNPQASLNPVFTIEQQFREIIHTHLALTAEVAKEKMLYALEETGFHDPRLCLNLYPHQLSGGMLQRICIAMALLCSPKLLIADEPTTALDVSVQYQILQLLKTLQKKTGMSLLIITHNMGVVAETADDVLVLYAGRMVECAPAVQMFHNPSHPYTRDLLASRPSLQPQQLGSFNPIPGQPPHYTAFPSGCRYHPRCSKILNRCSAEAPEIYPVREGHKVRCWLYDD

SEQ ID NO: 685 - protein, 328 aa, Chlamydia pneumoniae
  CPn0683
GVGCMTTNFPQPLIQATSLTKHYYKRSFWFQGKTIASRPVDDVSFSLYSRRAVGLIGESGSGKSTLALALAGLLPLTSGFLTFNGTPIKLHSKHGRHQLRSQVRLVFQNPQASLNPRKTILDSLGHSLLYHKLVPKEKVLATVREYLELVGLSEEYFYRYPHQLSGGQQQRVSIARALLGVPQLIICDEIVSALDLSIQAQILNMLAELQKKLSLTYLFISHDLAVVRSFCTEVFIMYKGQIVEKGNTKRIFSDPQHPYTRMLLNAQLPETPDQRQSKPIFQEYHKDSEESCSTGCYFYNRCPQKQEACKSEIIPNQGDAHHTYRCIH

SEQ ID NO: 686 - protein, 292 aa, Chlamydia pneumoniae
  CPn0684
EKSGDIVTEEISKDTIIEVAIDDIRVSPFQPRRVFSNEELQELIASIKAVGLIHPPVVREICTGDRVLYYELIAGERRWRAMQLAGATTIPVILKHVIADGTAAEATLIENIQRVNLNPIEMAEAFKRLIHVFGLTQDKVAYKVGKKRSTVANYLRLLALSKTIQESLLQGQITLGHAKVILTLEDPILREKLNEIIIQEHLAVREAELIAKQLISEEGSSIELKPTPLDMAESSKQHEELQQRLSDLCGYKVQIKTRGSKATVSFHLQNTQDLQKLEAWLSSHGTLSESLS

SEQ ID NO: 687 - protein, 64 aa, Chlamydia pneumoniae
  CPn0685
FPQSQYLLIFPNRILDLQAFEILDVQGMLTDQRKHIQMLHKHNSIEIFLSNMVVEVKLFFKTLK

SEQ ID NO: 688 - protein, 66 aa, Chlamydia pneumoniae
  CPn0686
AKDSMMRGGRLFRVYQELFFFSSVYVCEQRRPRKLYPSLQHLNFPIEKPRFLLKGFKKELHFYNHV

SEQ ID NO: 689 - protein, 238 aa, Chlamydia pneumoniae
  CPn0687
RKIHKNLRHAYRFSTPNCRSFMQKLVHNIWKKFYSFSSAIAICIVLASFLSLKIVSNTYKHSQAKRNSILLLTRAAEVAVSQGFLPSKSALSSLEQAYHLGGESMKPYAGFLASCFYIHNEPLRGAYYAGLAYNNSQALQLPHPIQKLLKEISEAQADQLYDVALSKSYQLLQTANSSPEYPTLSFLTLLRVIELKELLHQDVSQDFAALKSSPLFHQFERMYSDGEWTLSKRFGKKG

SEQ ID NO: 690 - protein, 254 aa, Chlamydia pneumoniae
  CPn0688
SLMLIVLAFRQVFFSHSRSQLDRLKNYLRLLKQNFAITLPKERTSKGHSLMLTFDFASFDFYTNIFPFLEEQKIPAVVGVASRYIPSNAAQDLHPSHRLKPSETLAFQDEIFSNYMPFCCQNELIEMAKSPYIQLASSGFAIRNLMNNPPYLTTEILLSRHHIETITGAKPLAFLFPFGKSDPTSRKLAADHYPYSFLLGNTINRKLKTHNIYRLDIKPMQYVCPSLFQSSRYLKNWIKEKSKQLYLKKQLPKR

SEQ ID NO: 691 - protein, 407 aa, Chlamydia pneumoniae
  CPn0689
SVKNLKEDFPIFAAKAKENEPFIYLDSAATTQKPQQVIDAVANFYTSSYATVNRAIYSSSRNVTEAYAAVREKVRKWVSAASDSEIVFTRGTTAGLNLLAISVNDLWIPKGGVVLVSEAEHHANVLSWEIACRRRGSLVKKIRVHDSGLIDLDDLEKLLNEGAQFVSIPHVSNVTGCVQPLQQVAELVHRYDAYLAVDGAQGAPHLPIDVQLWDVDFYVFSSHKIYGPTGIGVLYGKKDLLDQLPPVEGGGDMVAIYDHQNPEYLPAPMKFEAGTPNIAGVLGLGAALDYLDGLSAKFIYDKEIALTTYLHKELLEIPGVEILGPSIEEPRGALIGMTIDGAHPLDLGFLLDLRGIAVRTGHQCAQPAMERWNVGHVLRVSLGIYNDEDDIDQFILVLQDSLDKIRR

SEQ ID NO: 692 - protein, 423 aa, Chlamydia pneumoniae
  CPn0690
LSVLRGDKVLVSIETFSSIASGSPVQKAAEACYTQYSKQPSSKEVLSSFSWIQELSLFPDRYNLATGASELIKQHWLHNNHSLAFECILINGKYEPSLSQLPEGVIVCGIDEARGSLSSFMQGFDVNKHPLAFLNAVCSEDRGVVIYIPEEMQTSDPIFVRHISFPTVSDHDVIFSPRIVVILGQRASAQIQISHDVDLEMVGSSKTIVNGVTELFVGEGADLTVFMVPGYSEEDTLSWSTIATVEKDAICRMTQNLLESCQGFGWFDNTSYIVGKKGHAESLVLVQSPRKTWVNNLMSHDAEETVSRQNIKSILYSGHFLFEGTISISSQGDLSDANQKHDTLLLSSEARVSTFPRLEIETDEVKASHGATVGPLDPQQIFYMRSRGMTEAEAQEKLIHGFLKQGLVSDTFLGSSFQLNQTS

SEQ ID NO: 693 - protein, 261 aa, Chlamydia pneumoniae
  CPn0691
RGLGSMLKIKHLHASCNDVKILDDFNLNIQPGTMHVIMGPNGAGKSTLAKILAGDESVLVSSGEIALQEQNLLSMLPEERSRAGLFVGFQMPPEIPGVNNKMFLRDAYNARRRANQEGDISIDEFNTLLSTVLETYEYNATTDLFLDRNVNEGFSGGERKRNEICQMLVLEPEMVLLDEPDSGLDVDALRLICRVLEKYRELHPTSSLCIVTHNPKLGNLIRPDVVHLLLDGRVALSGDVSLMHELEAKSYQEVTKRVAWR

SEQ ID NO: 694 - protein, 495 aa, Chlamydia pneumoniae
  CPn0692
IQEFCATGLKVMGESVKVFLEEREDYPYGFVTPIESQGLTRGLSEETIEEIAALRNEPQFIIDFRLQAYRYWKQLHEPAWARLHYGPIAYDDIVYFSSPKQKKPLGRLEDADPEILDTFKKLGIPLDEQKRLLNVENVAVDLVFDSVSIGTTFKEALEKAGVIFCSLGEAIQEHPNLVKKYLGSVVSHRDNFFAALNAAVFSDGSFVYVPKGVKCPMDISTYFRINNKEAGQFERTLIVVEDGGYASYLEGCTAPAYSSNQLHAAVVELVAHEHAVIRYSTVQNWYAGDKKTGKGGIYNFVTKRGLCAGYRSKISWSQVEVGAAITWKYPSCILKGDESVGEFYSVALTSGKMQADTGTKMLHVGKRTTSTVISKGISSDESKNTFRSLVSLGKKAEHSSNYTQCDSMLIGKASGAYTDPKIVVENSTSSIEHEATTSKLREDQLLYLRSRGLSPEEAVSLVIHGFCREIIEQLPLEFAQEASKLLLIKLENSVG

SEQ ID NO: 695 - protein, 351 aa, Chlamydia pneumoniae
  CPn0693
LRSTNHVLGEISMEEAAKHLAKEFLCSGINLFLSGEYEQAEKRLKETLELDSTAALAYCYLGIIALETGRVSEALNWCSKGLASEPGDSYLRYCYGVALDRGNQYEAAIEQYSAYVALHPDDVECWFSLGSVYHRLKRLQEALDCFDKILALDPWNPQSLYNKAVILSEMDDEAESIRLLEVAVAKNPLYWKAWVKLGFLLSRSKRWDKATEAYERVVQLRPDLSDGHYNLGLCYLTLDKTRLALKAFQEALFLNAEDADAHFYVGLAHLDLKQMREAYEAFNSALSINLEHERAHYLLGYLHHMQGETDKATKELLFLQKKDSTFAPLLQKTVVSDPSSMQFERRLDTIS

SEQ ID NO: 696 - protein, 1102 aa, Chlamydia pneumoniae
  CPn0694
FSDESEAHNIHSMKRPKKFPIYLSIAQKTNRLLSGIVIAFAVIALRLWYLAVVEHEQKLEEAYKPQIRVLPQYVERATICDRFGKTLAVNQLQYDVSVAYGAIRDLPTRAWRVDEHGHKQLIPVRKHYIMCLSELLSQELHLDREAIEDAIHAKASVLGSVPYLVAANVSERTYLKLKMLSKDWPGLHVEAVVRRHYPQESVASDILGYVGPISLQEYKRVTQELSQLRECVRAYEEGEDPKLPEGLASIDQVRALLESVESNAYSLNALVGKMGVEACWDSKLRGKIGKKPILVDRRGNFIQEMEGAVPEAPGTKLQLTLSAELQAYADALLLEYEKTETFRSAKSLKKREKLPPLFPWIKGGAIIALDPNNGEILAMASSPRYRNNDFVNAKVAEDSKAVRSSIYRWLENKEHIAEIYDRKVPLIRERRNPLTGLCYEEILPLTFDCFLDFLFPENSVIKLQLKRNSFVGQAIEVQNLVTRLLSLFPYEEGTCPCSAIFDAVFPNEEGHILIQEVISLQEQKWIMECLNQHKADIEELKEALDQVFNELPANYDKILYTDILRLIVDPERFSPVLPSEVHRLSLSEFTELQGRYVVLRSAFSTILEDAFIEVHFKSWRKSEFLQYLAAKRQEEALRKQRYPTPYVDYLEEEKTRQYKMFCQEHLDTFLAYLFSKTPYKEGLEPYYDILDLWINELDNGAHRALSWHEHYLFLKERVSHLSEHLPALFSTFREFNELQRPLLGKYPISIVRNKRQTEQDLAASFYPVYGYGYLRPHAYGQAATLGSIFKLVSAYSVLSQRILWGHNEEPANPLVIIDKNSFGYRSSKPHVGFFKDGTPIPTFFRGGSLPGNDFMGRGFIDLVSALEMSSNPYFSLLVGEGLGDPEDLADAASLFGFGEKTGLGLPGEYAGRVPHDLAYNRSGLYATAIGQHTLVVTPLQTAVMLASLVNGGVVYVPKLLLGEWEGEHVSYLSSKKKRTIFMPDAVVEVLKTGMRNVIWGQYGTARAIQSQFPPQLLSRIIGKTSTAESIMRVGLDREYGTMKMKDIWFAAVGFSDQDLSLPTIVVIVYLRLGEFGRDAAPMAVKMIDMWEKIQQRESFLRG

SEQ ID NO: 697 - protein, 394 aa, Chlamydia pneumoniae
  CPn0695
SLEVSMKKLLKSALLSAAFAGSVGSLQALPVGNPSDPSLLIDGTIWEGAAGDPCDPCATWCDAISLRAGFYGDYVFDRILKVDAPKTFSMGAKPTGSAAANYTTAVDRPNPAYNKHLHDAEWFTNAGFIALNIWDRFDVFCTLGASNGYIRGNSTAFNLVGLFGVKGTTVNANELPNVSLSNGVVELYTDTSFSWSVGARGALWECGCATLGAEFQYAQSKPKVEELNVICNVSQFSVNKPKGYKGVAFPLPTDAGVATATGTKSATINYHEWQVGASLSYRLNSLVPYIGVQWSRATFDADNIRIAQPKLPTAVLNLTAWNPSLLGNATALSTTDSFSDFMQIVSCQINKFKSRKACGVTVGATLVDADKWSLTAEARLINERAAHVSGQFRF

SEQ ID NO: 698 - protein, 299 aa, Chlamydia pneumoniae
  CPn0696
NSGFYVRMPLLTYSNFEIEVQSLESQSCKLTIKDLMSAGAHFGHQTRRWNPKMKLYIFEEKNGLYIINLAKTLQQLRNALPHIRKVIQDNKTVLFVGTKKQAKCVIREAAIEAGEFFIAERWLGGMLTNMTTIRNSIKTLDKIEKDLSRNQAYLTKKEAALLAKRHQKLLRNLEGIRYMKKAPGLLVVVDPSYEKIAVAEAKKLGIPVLALVDTNCDPTPIDHVIPCNDDSLKSIRLIINVIKENIIEAKHKLGIEIVSPVKSLEVPDLSAFESSQDDESDEENREEDLLAKKFDGEAN

SEQ ID NO: 699 - protein, 287 aa, Chlamydia pneumoniae
  CPn0697
WRGKLMSDFSMETLKTLRQQTGVGLTKCKEALEACGGNLEEAVVYLRKLGLASAGKKEHRETKEGIIAAKTDANGTALIEVNVETDFVANNAVFREFVSNLLNDILKYKVDTVEALSQAASSQDPSLSVDELRAVTMQTVGENIRISRVAYFPKATNSTVGIYSHGNGKTVALTMLSGSSTADSLAKDIAMHVVAAQPQFLSKESVPAEAIAKEKEVIASQIQGKPQEVIEKIVTGKLNTFFQEACLLEQPFIKNADLSIQSLIDDFSKTSGSSVAIEQFILWKIGA

SEQ ID NO: 700 - protein, 253 aa, Chlamydia pneumoniae
  CPn0698
EPNKNMAKQTRRVLFKISGEALSKDSSNRIDEMRLSRLVSELRAVRNNDIEIALVIGGGNILRGLAEQKELQINRVSADQMGMLATLINGMAVADALKAEDIPCLLTSTLSCPQLADLYTPQKSIEALDQGKILICTTGAGSPYLTTDTGAALRACELNVDVLIKATMHVDGVYDKDPRLFPDAVKYDFVSYKDFLSNQLGVMDASAISLCMDSHIPIRVFSFLQHSLEKALFDPTIGTLVSEDVNHVCSPRH

SEQ ID NO: 701 - protein, 181 aa, Chlamydia pneumoniae
  CPn0699
TMSVLQDTEKKMAAALDFFHKEVKSFRTGKAHPALVETVVVDVYGTTMRLSDIASISVADLRQLVISPYDGNNASAIAKGIIAANLNLQPEVEGSIIRIKVPEPTADYRQEMIKQLRRKCEEAKINVRNIRREANDKLKKDSALTEDVVKGNEKKIQELTDKFCKQLDELTKQKEAEIASI

SEQ ID NO: 702 - protein, 172 aa, Chlamydia pneumoniae
  CPn0700
LMVHSPTHQCYHCQQPATICYTEIDKDKVIRSYVCATCPCPSHYYNNEHLSLSKGVGVLTLECGNCKTVWHSKQDDEQLLGCHQCYTNFKNQITSKLKSERVVSSSFTMEKGQGSLHIGRAPGEASNTNPLLKLIALNEALQDTLEREDYEQAAVIRDQINHLKTKNPDDPS

SEQ ID NO: 703 - protein, 363 aa, Chlamydia pneumoniae
  CPn0701
KPKIQMTLPNDLLETLVKRKESPQANKVWPVTTFSLARNLSVSKFLPCLSKEQKLEILQFITSHFNHIEGFGEFIVLPLKDTPLWQKEFLLEHFLLPYDLVGNPEGEALVVSRSGDFLAAINFQDHLVLHGIDFQGNVEKTLDQLVQLDSYLHSKLSFAFSSEFGFLTTNPKNCGTGLKSQCFLHIPALLYSKEFTNLIDEEVEIITSSLLLGVTGFPGNIVVLSNRCSLGLTEELLLSSLRITASKLSVAEVAAKKRLSEENSGDLKNLILRSLGLLTHSCQLELKETLDALSWIQLGIDLGLIKVTENHPLWNPLFWQIRRAHLALQKQAEDSRDLQKDTISHLRASVLKELTKGLSPESF

SEQ ID NO: 704 - protein, 924 aa, Chlamydia pneumoniae
  CPn0702
LKKNPVKTVILNIGRKILQGIKKKKKKIGILSGLFFLDLVLLGVSSQRPTETSANVKHNLRDEKLAACPKNSAASLSAKKSHTKKTTPGSIPSKVFSKFDATQDKTFQKTSGSAFPAKPTTLKELEERKKPRPERRTTADVKRSPRFLPTQEVEEPVPAASKEQLDSIQVWEEKQNYARRAVNAINLSIKKQLEEQTSTVTEKDVQPKTQATPHASKKNVASPSTSMPGIEKAATTVAVPQDKSEEEKVKERLTKRELTCEDLKDNGYTVNFEDISILELLQFVSKISGTNFVFDSNDLQFNVTIVSHDPTSVDDLSTILLQVLKMHDLKVVEQGNNVLIYRNPHLSKLSTVVTDSSLKETCEAVVVTRVFRLYSVSPSAAVNIIQPLLSHDAIVSASEATRHVIISDIAGNVDKVSDLLAALDCPGTSVDMTEYEVKYANPAALVSYCQDVLGTLAEDDAFQMFIQPGTNKIFVVSSPRLANKAEQLLKSLDVPEMAHTLDDPASTALALGGTGTTSPKSLRFFMYKLKYQNGEVIANALQDIGYNLYVTTAMDEDFINTLNSIQWLEVNNSIVIIGNQGNVDRVIGLLNGLDLPPKQVYIEVLILDTSLEKSWDFGVQWVALGDEQSKVAYASGLLNNTGIATPTKATVPPGTPNPGSIPLPTPGQLTGFSDMLNSSSAFGLGIIGNVLSHKGKSFLTLGGLLSALDQDGDTVIVLNPRIMAQDTQQASFFVGQTVPYQTTNTIIQETGTVTQNIDYEDIGVNLVVTSTVAPNNVVTLQIEQTISELHSASGSLTPVTDKTYAATRLQIPDGCFLVMSGHIRDKTTKVVSGVPLLNSIPLIRGLFSRTIDQRQKRNIMMFIKPKVISSFEEGTRVTNKEGYRYNWEADEGSMQVAPRHAPECQGPPSLQAESDFKIIEIEAQ

SEQ ID NO: 705 - protein, 507 aa, Chlamydia pneumoniae
  CPn0703
RKIGFMDCRGGIPLPEPQVIGGYHVKKILSKKLRSRVVHGLHPETRHSTVIKVFSPSPSFTSRSVYNFLKEAQSLHQITHPNIVKFHRYGKWQDCLYIAMEYIEGISLREYILAQFISLPQAIDIIFDIAQALEHLHSRNILHKDIKPENILITPQGKIKLIDFGLADWDTEIQRAHPSVIGTPYYMSPEQRQGESHSPASDIYALGLLAYELILGHLSLGRVFLSLVPERISKILAKALQPSPNNRYSSTREFIQDIHHYRMSGDMQEDLRIKDHTVALYEQLQTQRFWLAPETLRFPDFISGVLYHQGYPLYPHAYDTLLEGDVFNLWLGYSPISNATIALSVVKSLVCQQDLQRPLLDRVCEINECLIRMKIPIDEMGISILCLEISKENKELSWIACGKTVFWIKRQGRVVQDFESFSPGLGKITSLQIRETKVAWEIGDEAVVCTLELEESVASLKTLSLAELQDRRQKAIFCPIESIHGGIQSRQHGSNSPSTLISLKRIR

SEQ ID NO: 706 - protein, 374 aa, Chlamydia pneumoniae
  CPn0704
RYFMAVAADSSASWLKSRNNFLSSLGKTEEQVAAPEFPKELCQHKIREKFRLEDVQVSIKFRGSITAVEATKEFGVHLLIQPMVVQPWEVENLLFLTSEEDLQELMVAVFDDASLASYFYEKDKLLGFHYYFVAEACKLFEELQWVPSLSAKVGGDAIFTATSLQGSFQVVDISLRLDGKNVRCRLLLPEDTFQSCQKFFSGLHDESDLHNIDQTQQISLSVEVGYSQLTQEEWHQVVPGSFIMLDSCLYDPETEESGALLTVQKHQFFGGRFLTPSSGEFKITSYPNLTHEDPPLPENPQASAAPLPGYSRLVVEVARYSLAVSEFIKLNLGSILSLGNHPAYGVDIILDGAKVGRGEIIALGDVLGIRVLEV

SEQ ID NO: 707 - protein, 281 aa, Chlamydia pneumoniae
  CPn0705
FMELKKTAESLYSAKTDNHTVYQNSPEPRDSRDVKVFSLEGKQTRQEKTTSSKGNTRTESRKFADEEKRVDDEIAEVGSKEEEQESQEFCLAENAFAGMSLIDIAAAGSAEAVVEVAPIAVSSIDTQWIENIILSTVESMVISEINGEQLVELVLDASSSVPEAFVGANLTLVQSGQDLSVKFSSFVDATQMAEAADLVTNNPSQLSSLVSALKGHQLTLKEFSVGNLLVQLPKIEEVQTPLHMIASTIRHREEKDQRDQNQKQKQDDKEQDSYKIEEARL

SEQ ID NO: 708 - protein, 170 aa, Chlamydia pneumoniae
  CPn0706
YAVAKYPLEPVLAIKKDRVDRAEKVVKEKRRLLEIEQEKLREKEAERDKVKNHYMQKIQQLRDLLDEGTTSDAVLQIKSYIKVVAVQLSEEEEKVNKQKEVVLAASKELEKAEVNLAKRRKEEEKTRLHKEEWMKEALKEEARAEEKEQDEMGQLLFQLRQKKKRESGGS

SEQ ID NO: 709 - protein, 444 aa, Chlamydia pneumoniae
  CPn0707
VNMDQLTTDFDTLMSQLGDVNLTTVVGRITEVVGMLIKAVVPNVRVGEVCLVKRNGMEPLVTEVVGFTQSFAFLSPLGELSGVSPSSEVIPTGLPLHIRAGNGLLGRVLNGLGEPIDVETKGPLQNVDQTFPIFRAPPDPLHRAKLRQILSTGVRCIDGMLTVARGQRIGIFAGAGVGKSSLLGMIARNAEEADVNVIALIGERGREVREFIEGDLGEEGMKRSVIVVSTSDQSSQLRLNAAYVGTAIAEYFRDQGKTVVLMMDSVTRFARALREVGLAAGEPPARAGYTPSVFSTLPRLLERSGASDKGTITAFYTVLVAGDDMNEPVADEVKSILDGHIVLSNALAQAYHYPAIDVLASISRLLTAIVPEEQRRIIGKAREVLAKYKANEMLIRIGEYRRGSDREIDFAIDHIDKLNRFLKQDIHEKTNYEEAAQQLRAIFR

SEQ ID NO: 710 - protein, 235 aa, Chlamydia pneumoniae
  CPn0708
AFKTVKRFFCFMIDPVECFPNLDGDAEAQSITQNSGTPLASELKKDISPFALGSYAAPKDTTLVQGFKPNPMAMMQDQNSNLIDPELQEALESEELQEQINNLKGRLWDFRSTFEDSQTTAQFADEHFQAVGVIIDLINEDLNTIAEHTQQDARKEDKEEGSVTRKIIDWVSSGEEVLNRALLYFSDRDGNRESLANFLKVQYAVQRATQRAELFASIVGTSVSSVKTIMTTQLG

SEQ ID NO: 711 - protein, 154 aa, Chlamydia pneumoniae
  CPn0709
YKREIMADLEVFQADFALLFEAGLLAIKQGDEDSARKLFQSLHILNPNHYGHDLGLALISLHKMDLFDAEERLSALIKGNEDNWSIKAFLSLTHMLIVLHQGSSFEVRRESLESCLKFADQVIANCKIESTRALAQSVLDWHDTLVAKSAGPLG

SEQ ID NO: 712 - protein, 91 aa, Chlamydia pneumoniae
  CPn0710
RSRGEKSMATNKSCTAFDFNKMLDGVCTYVKGVQQYLTELETSTQGTVDLGTMFNLQFRMQILSQYMESVSNILTAVNTEMITMARAVKGS

SEQ ID NO: 713 - protein, 102 aa, Chlamydia pneumoniae
  CPn0711
TTINNQVLGFINYLYLGRYSMFNMENTAKEEKNSQPLLDLEQDMQDHDRAQELKASVQDKVHKLHALLREGSDKESFGQQQSLLAGYVALQKVLGRINRKMI

SEQ ID NO: 714 - protein, 845 aa, Chlamydia pneumoniae
  CPn0712
MAVRLIVDEGPLSGVIFVLEDGISWSIGRDSSANDIPIEDPKLGASQAIINKTDGSYYITNLDDTIPIVVNGVAIQETTQLKNEDTILLGSNQYSFLSDEFDPQDLVYDFDIPEENFSNDSGDLSDSNEQGKDLEPRQTSETNHSPKPKEKLTKDQGSSDPITSGDQELADAFLASAKAEKNQPRAKVAKKGLKESSNESLNPKEQNAKDSPKGEERTNKPQNAIMEDNGASPRQDPQPKSAEPSLKNTARDETPLKENKPVEEKANKKATPDSPEKKDQPEEGSKKEGSKIEATPLDSQKESEDKEAEEAFVQEEEENLTEDNKEDSDSAADANDDTASDHTAEDNKETPKKVENEKSAVLSPFHVQDLFRFDQTIFPAEIDDIAKKNISVDLTQPSRFLLKVLAGANIGAEFHLDSGKTYILGTDPTTCDIVFNDLSVSHQHAKITVGNDGGILIEDLDSKNGVIVEGRKIDKTSTLSSNQVVALGTTLFLLIDHHAPADTIVASLSPDDYSLFGRQQDAEALERQEAQEEEEKQKRATLPAGSFILTLFVGGLAILFGIGTASLFHTKEVVPLENIDYQEDLAQVINQFPTVRYTFNKTNSQLFLIGHVKNSTDKSELLYKVDALSFVKSVDDNVIDDEAVWQEMNILLSKRPEFKGISMHSPEPGKFIITGYVKTEEQAACLVDYLNIHFNYLSLLENKVVVETQMLKAIAGHLLQGGFANIHVAFVNGEVILTGYVNNDDAEKFRAVVQELSGIPGVRLVKNFAVLLPAEEGIIDLNLRYPNRYRVTGYSRYGEISINVVVNGRILTRGDVIDGMTVTSIQPNAIFLEKEGLKYKIDYNK

SEQ ID NO: 715 - protein, 162 aa, Chlamydia pneumoniae
  CPn0713
LDLKEEKAGFRNEIVSIPQGTKTTIAALENTSMLEKLIKNFATYMGITSTLELDADGAYVLPISEVVKVRAQQNADNEIVLSASLGALPPSADTAKLYLQMMIGNLFGRETGGSALGLDSEGNVVMVRRFSGDTTYDDFVRHVESFMNFSETWLSDLGLGKQ

SEQ ID NO: 716 - protein, 345 aa, Chlamydia pneumoniae
  CPn0714
NYRIVLMVLGVVGISYREAALKERERAIQYLQSFEKNLFLAQRFLGKGGAFIPLLTCHRAELYYYSESPEIAQAALLSELTSQGIRPYRHRGLSCFTHLFQVTSGIDSLIFGETEIQGQVKRAYLKGSKERELPFDLHFLFQKALKEGKEYRSRIGFPDHQVTIESVVQEILLSYDKSIYTNFLFVGYSDINRKVAAYLYQHGYHRITFCSRQQVTAPYRTLSRETLSFRQPYDVIFFGSSESASQFSDLSCESLASIPKRIVFDFNVPRTFLWKETPTGFVYLDIDFISECVQKRLQCTKEGVNKAKLLLTCAAKKQWEIYEKKSSHITQRQISSPRIPSVLSY

SEQ ID NO: 717 - protein, 609 aa, Chlamydia pneumoniae
  CPn0715
KFNKISHMAAYTEASILSLASLDHIRLRAGMYIGRLGNGSQKEDGIYTLFKEVVDNGIDEFIMGHGKSLKISASDKQISIQDQGRGIPLGKLIDCVSKINTGAKYTQDVFHFSVGLNGVGLKAVNALSEIFSVRSVRKKKYHLATFHRGVLQESKQGSTKDPDGTFVSFTPDPSIFPEFTFNHDFLKDKIRQYTYLHSGLEIRFNDEVFISHNGLKDLFDAEITEPPLYSPLFFQNEDLTFIFSHLEGNTERYFSFVNGQETLDGGTHLTAFKEAIVKGVNEFFGKTFVSNDIREGIVGCIAIKIASPIFESQTKNKLGNTQIRSSLIKDVKEAIVQALRKDKVAPELLLEKIKFNEKTRKNIQFIKQDLKSKQKKVHYKIPKLRDCKFHYNDRSLYGEASSIFLTEGESASASILASRNPLTQAVFSLRGKPMNVFSLEETKMYKNDELFYLATALGITQNEIQHLRYNKVILATDADVDGMHIRNLLITFFLKTLLPLVENNHLFILETPLFKVRNKTTTLYYYSEQEKMQALQQFGKKDSSLEITRFKGLGEISPKEFAAFIGPEIRLTPVTITSLESISSILQFYMGKNTKERKQFIMDNLITDF

SEQ ID NO: 718 - protein, 479 aa, Chlamydia pneumoniae
  CPn0716
FMRDVSELFRTHFMHYASYVILERAIPHILDGLKPVQRRLLWTLFLMDDGKMHKVANIAGRTMALHPHGDAPIVEALVVLANKGYLIDTQGNFGNPLTGDPHAAARYIEARLSPLARETLFNTDLIAFHDSYDGREKEPDILPAKLPVLLLHGVDGIAVGMTTKIFPHNFAELLKAQIAILNDKKFTVFPDFPSGGLMDPSEYQDGLGSITLRASIDIINDKTLVVKQICPQSTTETLIRSIENAAKRGTIKIDTIQDFSTDVPHIEIKLPKGSRAKEMLPLLFEHTECQVILYSKPTVIYENKPVECSISEILKLHTTALQGYLEKELLLLQEQLTLDHYHKTLEYIFIKHKLYDSVREVLAINKKISADDLHQAVLHALEPWLHELATPVTKQDTSQLASLTIKKILCFNEEACTKELLAIEKKQAAIQKDLGRIKEVTVKYLKGLLERHGHLGERKTQITNFKTAKTSILKQQTLI

SEQ ID NO: 719 - protein, 113 aa, Chlamydia pneumoniae
  CPn0717
IRIKFIDTITIVVRMEPRHIYIRKPETPKAPDVEKPGVPEYMTMANTPTFEGPVKTLDQLRRALIEQRGAEEGQKMYDNFIQSILISTFGLVHKDMDRAQKASKRMRSVYKEQ

SEQ ID NO: 720 - protein, 109 aa, Chlamydia pneumoniae
  CPn0718
RAVMSFTYFLALPVDRLMQERFLCSPKRWAPFINSPLYLTLIADHDTPYLAKNLDKFPLPVEQWEKTVLHVSSLLKSIFLCSDLSSLRLLACTKFEILTLNDLYCAQNI

SEQ ID NO: 721 - protein, 338 aa, Chlamydia pneumoniae
  CPn0719
FDIKLVKKVIKISMKTVTSFTVCKENSGRLDKYLTEVHPKYSRAFYQEHILSGLVQINGQINTRVATRLNCGDIVTIDIQEKEELLELLPEAIPLDKVYEDGMILVINKPRDMVVHPAPGHFHGTLVHALLHEIGERLKEEFPEEPWRPGIVHRLDKDTSGLIITAKTRQAKKVFSELFSTKRLKKSYLAVCIGKPRSTTIHTHISRHQNKRKEMTVSSQGKEAVTHCQVLAFNGKLSFVALSPETGRTHQLRVHMKHLGTPILGDPVYGIPSMNSSYGLDKQQLHAYSVDFTHPETRQFCSLKAGLPEDMRSLLIKEFRNETTILNKNLLESILKEQ

SEQ ID NO: 722 - protein, 82 aa, Chlamydia pneumoniae
  CPn0720
LRITMKEFLAYIIKNLVDRPEEVRIKEVQGTHTIIYELSVAKPDIGKIIGKEGRTIKAIRTLLVSVASRNNVRVSLEIMEEK

SEQ ID NO: 723 - protein, 273 aa, Chlamydia pneumoniae
  CPn0721
KRMVMFNNKMILIAGPCVIEGEDITLEIAGKLQSILAPYSDRIQWFFKSSYDKANRSSLNSFRGPGLTEGLRILAKVKETFGVGILTDVHTPQDAYAAAEVCNILQVPAFLCRQTDLLVATAETGAIVNLKKGQFLSPWDMEGPINKVLSTGNNKILLTERGCSFGYNNLVSDMRSIPVLSRSGFPVIFDATHSVQLPGALSTESGGLTEFVPTLSRAALAAGAHGLFIETHTNPKIAKSDAASMLSLEEFAALLPTWDQLFTCVSSFDMVSA

SEQ ID NO: 724 - protein, 166 aa, Chlamydia pneumoniae
  CPn0722
YGLSMTKFLYCGLFYSLGLLVLAFGTMVAIIQVDQICDVSCMNKHFQESPPFLKIKKVNVSKQICSPEERFFHCKIDKSCMELHFPQSSYSCKEYLTRISGHILTQNFEKQMQFRGNSGLLNYQDGSLHVYDCRFQVDPVPGYGSPDKEDSSSGGMKTLYLSLFRN

SEQ ID NO: 725 - protein, 242 aa, Chlamydia pneumoniae
  CPn0723
ASMPILSVCNLVKKYNKKPVTNDVSFQINPGEIVGLLGPNGAGKTTAFYLTVGLIRPDSGKIIFKNVDVTKKTMDHRARLGIGYLAQEPTIFKELTVQDNLICILEIIYKARKQQSHLLNTLVDDLQLGSCLHKKAGTLSGGERRRLEIACVLALNPSVLLLDEPFANVDPLVIQNVKYLIKILAGRGIGILITDHNAKELLSIADRCYLIIDGKIFFEGSSSQMISNPMVKQHYLGDSFSY

SEQ ID NO: 726 - protein, 299 aa, Chlamydia pneumoniae
  CPn0724
RTSTRLDYRSGCILSKILPFPELWKMLLGFLCDCPCASWQCAAVANCYDSVFMSRPEHKPNIPYITKATRRGLRMKTLAYLASLKDARQLAYDFLKDPGSLARLAKALIAPKEALQEGNLFFYGCSNIEDILEEMRRPHRILLLGFSYCQKPKACPEGRFNDACRYDPSHPTCASCSIGTMMRLNARRYTTVIIPTFIDIAKHLHTLKKRYPGYQILFAVTACELSLKMFGDYASVMNLKGVGIRLTGRICNTFKAFKLAERGVKPGVTILEEDGFEVLARILTEYSSAPFPRDFCEIH

SEQ ID NO: 727 - protein, 81 aa, Chlamydia pneumoniae
  CPn0725
SCGDVGMFFAPLLYESLRRGLMHPTSHMQQQLARLEFINDQLTTELEHVNELLCSLGFPEGLTTIKAIAEEVLSDDEPLLD

SEQ ID NO: 728 - protein, 835 aa, Chlamydia pneumoniae
  CPn0726
ADIDMIYSTSISTFYKKLSLVSSMHSFAQRHRESLEHIANYEKTTAERDILKRLIEVLDQRASERYRSAVEKLHKYEVERATVAKSIPVAAIHEKPLSSTHASVQVTASTPAATGSGVGAYYNAVKQKWAQDLIVELNTVMTTIMASVNSKNPANKDVFDKLNTELQALVAAGNNLTEENFQTLYNFPEEIFTAIQRADTFTGGMKTDFTNQLAGKYGNQATLTQTFADGRVEGFKDILTAVQGVLTPEQFTIFAEIATELQALADHVGNFDEAGLQRIEDAGEKLAAVINSSDLTRNDKIMFCQHITDLYSDQVAALGSFDTVLDASIYVNQHQGTMFSNLSSFVGSLIGTFAPIDLSSSQGDISSAALAGALQTARGLNSRFNELTAEQQKLINECIKSLVTFKCGEHLGAIWAYFTASTVVALNPTATMDHVKAAILEEAKELDNSSFQLASSIKSAMTSIVNSSGSFSVTVNSSTLQYTIYSEKNGKVEINQILLNYGSTGFLPEITKLAKTNAESTARSYFRFKALAAVESENVQNKIEDLQSQLQQFTNMKTELFDGQLLSQASELRALPLPSAVASVLIDRYMPKEVDYLNEIYKKLYYSNLGSSIGNSIIDAISQYVNGATYFNFASYVGQQPAVGAGGANAFPGSQESAQAKLDQERKQAALYLQETRGALTVIEEQRARVLKDDKITNEQRSTILDSLRNYEDNINSISGSLVLLQNYLQPLSIAGGSVAGTFEVKEGQEQWQARLQILEEALVSGLVGNMINGGMFPLQSTIQSDQQSFADMGQNFQLDLQMHLTSMQQEWTVVATSLQLLNQMYLSLARSLTG

SEQ ID NO: 729 - protein, 878 aa, Chlamydia pneumoniae
  CPn0727
KYYLFSMSTFSIQNRLRTISGESTRIIKLDHKYSGFDPRSVPAINLEELNSGIYALRHLMNALQSENTNVAALLNPNNTIFPTTSWTDYKHSRPQASSPRAPSSQTPTDIVSAAALALVLVIDGGLAELVASVTEIDLGALSTISTVRQLMASYLGLTTLTAEQEKVVFSSSYVPSEKNLLEHVKQEKAAEIQAKQEEIKAVLEAKGVSTEEIEAILKEYPDIYAADFFKEFIEEPLHTYRAKVGAPIQEMNENAIQLLPTPPAITPDNVNEVNGMNTLSTILQAIDDAIKQAPALGGDQEIITILQTLVPLVDKTTFTKAEFDLIYTATQLPNTASLKLYLTDRQIAEYRGKITKVYQNSIQNLSETKRVVENNRSMLETQLSMFQQAQNCFVTWISQANALNIAITNKYISAVLTTSMEMYGGLLCLSYMYERLADDEKAIFDKSVNEYLPIHIVVGGSWVNGWIAKMAAYQELAEYSLGTAVTSQDQIKAYLQTRGNEFKATRHFFHNIGDQMYQFANETVFGNCLTTANGAIQPDLGGFIREAMTNVGTVEADYVSNAQRILNEFNTAATAHVLQLQLQIAELQKKADDLDPGKASFTENRKFAVAAWITSESLGDALISMILNSQLPKQEAFLKPLIEEINFNNLAANALNSLLQITNEFSTTSVYYSLSSYLVQSKTGQNLFAGDYYETLLAAAREREYIYRDTARCKQAINLVNGLLQKINSLPGATSAQKQEMLNATTYYQYSLSVTLNQLTVLESLLAGLKMTLQTTSNNKYDKSVFKIESFDDWIPTLAALESFLTSGFPNISATGGLGPLFTQVQSDQQTYTSQGQTQQLNLQNQMTTIQQEWTLVSTSMQVLNGILSQLAGAIYSN

SEQ ID NO: 730 - protein, 653 aa, Chlamydia pneumoniae
  CPn0728
VFMVNPIGPGPIDETERTPPADLSAQGLEASAANKSAEAQRIAGAEAKPKESKTDSVERWSILRSAVNALMSLADKLGIASSNSSSSTSRSADVDSTTATAPTPPPPTFDDYKTQAQTAYDTIFTSTSLADIQAALVSLQDAVTNIKDTAATDEETAIAAEWETKNADAVKVGAQITELAKYASDNQAILDSLGKLTSFDLLQAALLQSVANNNKAAELLKEMQDNPVVPGKTPAIAQSLVDQTDATATQIEKDGNAIRDAYFAGQNASGAVENAKSNNSISNIDSAKAAIATAKTQIAEAQKKFPDSPILQEAEQMVIQAEKDLKNIKPADGSDVPNPGTTVGGSKQQGSSIGSIRVSMLLDDAENETASILMSGFRQMIHMFNTENPDSQAAQQELAAQARAAKAAGDDSAAAALADAQKALEAALGKAGQQQGILNALGQIASAAVVSAGVPPAAASSIGSSVKQLYKTSKSTGSDYKTQISAGYDAYKSINDAYGRARNDATRDVINNVSTPALTRSVPRARTEARGPEKTDQALARVISGNSRTLGDVYSQVSALQSVMQIIQSNPQANNEEIRQKLTSAVTKPPQFGYPYVQLSNDSTQKFIAKLESLFAEGSRTAAEIKALSFETNSLFIQQVLVNIGSLYSGYLQ

SEQ ID NO: 731 - protein, 438 aa, Chlamydia pneumoniae
  CPn0729
PAWSSVSTLNIDTKDTMKKQVYQWLASVVLLALTISGYAELPLSEQKVKSHTYTTLDEVKDYLSKRGFVETRKQDGVLRIAGDVRARWLYFREDIKNPSDKDKYNPLPVNRYRSEFYLYIDYRAERNWLSSKMNWTAIAGGENTAAGVDINRAFLGYRFYKNPETRTDFFMEIGRSGLGDLFESEVQFQSNFDGLHIYWTRELSKDYPYQVIVHGGPFVVNMTKKHYAWVVEGILNRLPKQFFVKCSVVDWNTFVPSETSTTEKAATNAMKYKYCVWQWLVGKHSQVPWINGQKKPLYLYGAFLMNPLAKATKTTLNGKENLAWFIGGTLGGLRKAGDWSATVRYEYVEALSVPEIDVSGIGRGNLLKFWFAQAIAANYDPKEANGFTNYKGFSALYMYGITDSLSFRAYGAYSKPANDKLGSDFTFRKFDLGIISAF

SEQ ID NO: 732 - protein, 558 aa, Chlamydia pneumoniae
  CPn0730
SCFKGGGENGLMSRKDNEVSLARSIFNILSGTFCSRITGIFREIAMATYFGADPIVAAFWLGFRTVFFLRKILGGLILEQAFIPHFEFLRAQSLDRAAFFFRRFSRLIKGSTIIFTLLIEAVLWVVLQYVEEGTYDMILLTMILLPCGIFLMMYNVNGALLHCENKFFGVGLAPVVVNIIWIFFVIAARHSDPRERIIGLSVALVIGFFFEWLITVPGVWKFLLEAKSPPQEHDSVRALLAPLSLGILTSSIFQLNLLSDICLARYVHEIGPLYLMYSLKIYQLPIHLFGFGVFTVLLPAISRCVQREDHERGLKLMKFVLTLTMSVMIIMTAGLLLLALPGVRVLYEHGLFPQSAVYAIVRVLRGYGASIIPMALAPLVSVLFYAQRQYAVPLFIGIGTALANIVLSLVLGRWVLKDVSGISYATSITAWVQLYFLWYYSSKRLPMYSKLLWESIRRSIKVMGTTMLACMITLGLNILTQTTYVIFLNPLTPLAWPLSSITAQAIAFLSESCIFLAFLFGFAKLLRVEDLINLASFEYWRGQRGLLQRQHVMQDTQN

SEQ ID NO: 733 - protein, 90 aa, Chlamydia pneumoniae
  CPn0731
VAIAISRNIPVIRLQKVPDNILKIERAKETSLMSFLLIKPFSPPPLKQDYLFDISPYTSSEITIGGSYFKLNKASLQSSTLRLRSISIIS

SEQ ID NO: 734 - protein, 295 aa, Chlamydia pneumoniae
  CPn0732
NFMKVLPPPSIPLLGAHTSTAGGLKNAIYEGRDIGASTVQIFTANQRQWQRRALKEEVIEDFKAALKETDLSYIMSHAGYLINPGAPDPVILEKSRIGIYQEILDCITLGISFVNFHPGAALKSSKEDCMNKIVSSFSQSAPLFDSSPPLVVLLETTAGQGTLIGSNFEELGYLVQNLKNQIPIGVCVDTCHIFAAGYDITSPQGWEDVLNEFDEYVGLSYLRAFHLNDSMFPLGANKDRHAPLGEGYIGKESFKFLMTDERTRKIPKYLETPGGPENWQKEIGELLKFSKNRDS

SEQ ID NO: 735 - protein, 213 aa, Chlamydia pneumoniae
  CPn0733
GLKYMARYCGPKNRVARRFGANIFGRSRNPLLKKPHPPGQHGMQRKKKSDYGLQLEEKQKLKACYGMIMEKQLVKAFKEVIHKQGNVAQMFLERFECRLDNMVYRMGFAKTIFAAQQLVAHGHILVNGRRVDRRSFFLRPGMQISLKEKSKRLQSVKDALESKDESSLPSYISLDKTGFKGELLVSPEQDQIEAQLPLPINISVVCEFLSHRT

SEQ ID NO: 736 - protein, 351 aa, Chlamydia pneumoniae
  CPn0734
QNTKEHFSSNGNFLQCNYFQDYVRVFIMEKKYYALAYYYITRVDNPHEEIALHKKFLEDLDVSCRIYISEQGINGQFSGYEPHAELYMQWLKERPNFSKIKFKIHHIKENIFPRITVKYRKELAALGCEVDLSKQAKHISPQEWHEKLQENRCLILDVRNNYEWKIGHFDNATLPDIQTFREFPEYAEKLAQECDPETTPVMMYCTGGIRCELYSPVLLEKGFKEVYQLDGGVIAYGQQVGTGKWLGKLFVFDDRLAIPIDESDPDVAPIAECCHCQTPSDAYYNCANTDCNALFLCCDECIHQHQGCCGEECSQSPRVRKFDSSRGNKPFRRAHLCEISENSESASCCLI

SEQ ID NO: 737 - protein, 226 aa, Chlamydia pneumoniae
  CPn0735
GEKFMLMMLMMIIGITGGSGAGKTTLTQNIKEIFGEDVSVICQDNYYKDRSHYTPEERANLIWDHPDAFDNDLLISDIKRLKNNEIVQAPVFDFVLGNRSKTEIETIYPSKVILVEGILVFENQELRDLMDIRIFVDTDADERILRRMVRDVQEQGDSVDCIMSRYLSMVKPMHEKFIEPTRKYADIIVHGNYRQNVVTNILSQKIKNHLENALESDETYYMVNSK

SEQ ID NO: 738 - protein, 580 aa, Chlamydia pneumoniae
  CPn0736
RGELLKLARQCLVAFMTVSVKKKSFRALVTTHFLTIINDNLYKFLLAFFLLEGKTLTENAKILSCVSFFFALPFLLLAPLAGSLADRFQKRNIILATRFIEILCTILGTYFFFIQSVVGGYVVLILMACHTTIFGPAKLGILPEMLPSEQLSQANGIMTAATYTGSILGSCLAPLLVDVTHRLGVNSYVWPTLMCVIVSIISTLISFCIRPSNVKNVKQKITLVSFKDLWKVLKDTRMIHYLTVSIFLGSFFLLIGAYTQLEIIPFVEFTLKYPKHYGAYLFPIVALGVGTGSYITGKISGKDIKIGYVPLAAIGLALVFMGLYAFACSILFVLFFLLALGFLGGVYQVPLHAYVQYASPEHKRGQILAANNFLDFFGVLVAAGVIRVLGSNLGLSPETSFFYIGWFVLAVSIWTLWIWREHVYRLLLGIILRRQLGYYLKIHQSSSPKCYFVAVQSYREIRRVLAALTKTVRSRVIILDQKLVPGWRAWLLSWCVPTVVSSVRDNDSEAQDAWAVLQANHLKTSLKKFPDVSVVCLGLPKNVERFTSILQEQGIDLHPIQLVQKEGKKRVIYTLVFPHA

SEQ ID NO: 739 - protein, 1096 aa, Chlamydia pneumoniae
  CPn0737
KRSAKLPASGASKRKGRAKKKLTQERIFAFSVRVLPSNRKNAKRNLYKLSFIIVRKCVVTSALNDFFLTETVMNATKHCRASFSNSPRHLLAQLAEDITSTHQKPFTKRWILVANATTGHWIKNQLVHVLSDHIFMGSTIFTASDSIVKHLFLGSGCSQPNIPDYLTLPLLINNILEEISKASKFENGREFLSPPTYETTKKLAAAFKQFHTFSQRPTKNASHYQELFQILESHFSSYEEMFTTILNNRTQEEDCSLHIFGYAHLPKHLAEFFINLSTYFPVYFYCFSPCREYFGDLLSDRAIDFFWNQLPDSPIKNAWEHYVLSDRQALLANLAHKSQSSQNFFLDREIDYQEMFLPSKHDSSLGVIQNSILDLKPTSPQDFSQTKQTICIYRALNIPREVQEVFCKVTELLHRGVSPEEIFILSSHIESYKVHLNAIFNPHVPIYFTDEVDPRAEDLRNKILLLSSILQTQGDLHYILQLLTHPQLQQPIDQNKVPYLIKKLSSEWGKISSKDRASGQQMKALGDLILEEYPFHQEGGRVSQVEVWETTVPLIYFIQERINLYLSSSQHSYEDLFQNVFSCLEKIFVLSPEETSFITTLRNSLFPTFATSSCSLLFFTDFCLDFLLHFHKPSPLYDKPGPYIGSLSSLSLIPKGYVFILGANKTTSSDIFDLLNRTTTHEELAFSSTEDEENFHFLQILVSTKHELHISYISSAAQFNLPSPFLNHIKETLDLPVETLPTQPYLSAFFKNKACLHTSQEYNYSLAHAFYSKKALLPSLFIPTVKQVNLPQHLSLNEIIKGIFSPLDLFLKTNYNLRISYPEHLKKQQKLFPTKHQIEDFWNECFVDKEHDLIPSISPHAEELFTYYREKTILLRNGLDKDPKHSPYTVTFSSSIFEERPYHESYLFPPLSLSFQGNPVQIHGTIHGVCNEGLYLCSIDPRDSLKKTTRTLGSLPETSSEQKQLLERYVALAVLQMSQHLSSDSALIKLTSFNTKENHHPPFSDPEGYLRKVLEVYHLMSSQPIPLLSPLCWKTLDDEEKFHQAVLSAISEEAKNPSLPIFWQFHNRNIEEILNHVGASERLKILSLFRGPCEAV

SEQ ID NO: 740 - protein, 1060 aa, Chlamydia pneumoniae
  CPn0738
KFYLFSEVPVMKPFNIFDSNSSIQGKFFLEASAGTGKTFTIEQIVLRALIEGSLTHVEHALAITFTNASTNELKVRIKDNLAQTLRELKAVLNSQPASLPTYLDINCNVKQIYMQVRNALATLDQMSLFTIHGFCNFVLEQYFPKTRLIHKNPALTHSQLVLHHITNYLKQDLWKNVLFQEQFHLLAVRYNITSKHTSSLVDKLLASYTQPISSYFSSRVERLEQISLWHQQIYNSLLEIPKQVFLDQLTAHISGFKKQPFSILDDLHHFVDLLYTSETHSSLFSFFKIAETFNFKHRLARYKPCAAFTVLENMSWVERTLEFCNLDRIFNTLLVDLQEYLKQNYTPWLSPDESVFALEKLLSSSEAQPVVQALREQYQLVLIDEFQDTDKQQWSIFSNLFISPKFTGSLFLIGDPKQSIYEWRSADLPTYLTAKSSFSEDKQLQLVNNYRSTPKLMEAINQIFGKISPFLEIPGYLPIEYHALNPQSSETFENPPHAPIHFFFYETIKDQALWIFSEALRLQKEQKIPLGNMVVLVSDSNQAFELISYATIPVSFSKNKSIFHLTETHILTTALLEAILHPENYEKISKILFSSLFGLSLDEVTTKKEDFTIYFQSLHSYISHHGLLATFYRVMTTQGNVLFSSPRGDLIFQEMEKLCGYLDTISSYPYHQLLHLKNFSETGRWEEELAISSYSEDLETLKITTIHSSKGLEYDIVFCPGIEKSKKNKSSSELLREMYVACTRAKKQLYLPISTQPPSLQRSSALTNYVKLEGTQSSAYDLAIHLHQEHPDLFSYSLPKDHGHATTVLNLPLLETFALKVTPPKTIFSFSSTKFLLDTHKDSQSIPYSKLPISKQQLPLGEKTGILIHKILESIQFSLLQDTEYLMSTIMRFIKHTHLEGFEETILKLLSKTFFSPLTFSSQTFSLSQVLPNKIFRETSFLFLENQELWQGVIDLFFEHEGKYYIIDWKTSFLGETNSDYSKSNLSIYIKQEKLDYQGRIYVKAVRKFLNQFEIDDDVELGVIFIRGIDTQGNGFFALNSSEDIPNFNPKAIQKCQAYH

SEQ ID NO: 741 - protein, 344 aa, Chlamydia pneumoniae
  CPn0739
CKVLFKLMSYSLRNKKTKICVYIIIALGILSFRSIPQEVYDKIRSSFVSLHVKFFPKIKQAPSSHLANLELENLVLKERVASLEEKLKLYEVSNHTPPLFPEILTPYFHKLVEGKVVYRDYTHWSSSCWVNVGKTHGIKKNSPVLSGNVLVGLVDYVGEHQSRIRLITDVGMKPSVVAMRGDIQSWWIKHSLRELIRQVEQISHAYILEKDKYEKISQLQELDSLIQGEGENQALLRGILSGVGGALWKEGSLCLEGEGFYFSEGKTLLPGDILVTTGLDGVFPPGLLVARVTKVKAPRDGACTFKIEAQSLEEKLMELDQLFILPPLEFNPNDRPDIFGLLWD

SEQ ID NO: 742 - protein, 397 aa, Chlamydia pneumoniae
  CPn0740
SYMSFFNHIPTFSPDAILGLQNVFFADKRPEKVNLVIGVYEHPQKRYGGLSCIRKAQTVILEEEQNKSYLPISGLQIFLDEMRELVFGAVDPSAIVGFQSLGGTGALHLGARLLSVAKGSGKVYVPEQTWSNHIRIFSQEGLEVIRYPYYSKEQKQLLFEPLIAFLKEVEKNSVILLHGCCHNPTGVDFTEDMWKELAILMKERELIPFFDTAYQGFAHGIELDRKPIEIFISEGNTVLVAASSSKNFALYGERVGYFAVHSTFTDELVKIHSFLEEKIRGEYSSPQRWGVEIVSTILSNPYLKEEWQSELNFIRESLGKMRTRFVQALRKVAGHTFDFLLSQHGFFAYPGFSDKQVLFLREQHAVYTTAGGRMNLNGITEKNIDHVVQSFIQAYEL

SEQ ID NO: 743 - protein, 733 aa, Chlamydia pneumoniae
  CPn0741
EYIFRLKTGDIVDYLEKLQVLIEEGQSANFLSLWEEYCFNDVVRGRELVEILEKVKSSSLASLFGKIVDTVVPLWEKIPEGKDKDRVLQLILDLQTSNSQMFFDIATEYVNKKYSGEENFNEALRVVGLRDGRDFQFSLSRFDFLMHMHKGNFVFHQGGWGVGEVMGVSFLQQKVLIEFEGIMSAKDISFETAFKSLTPLSGDHFLSRRFGDPDGFEAFAKENPIEVVEILLRDLGPKTAKEIKDELVDLVIPEADWNRWWQSAKTKIKKGTRIISPDNPKEPYVLSDAGCSHMGQLERKLGLSLNSAEKISLIYHFIRDLHSELKNIEIRKSLVKALQDLDVEEGNKSLILQRELLLSEYLGIKDASIDKEYITSLSEDDTSRLLENMPIVALQKSFLSLVRKYSSFWQQVFMQILLYTTSPTMRDFVYKTIKNDPSSVEVLKKRLLDSAHQPMMFPELFVWFFLKLGNHEDGLFDPEDKEVLRLFLESALNFMYQVASTPHKELGKKLHHYLVGQRYLAVRQMIEGASLPFLKELLLLSTKCPQFSSSDLNVLQSLAEVVQPTLKKHKSNVEEENVLWSTSESFSRMKAKLQSLVGKEMVDNAKEIEDARSLGDLRENSEYKFALEKRARLQEEIRVLSEEINRARILTKDLVFTDKVGVGCKVTLKGDAGEVVEYTILGPWDADPDSCILSLQSKLAQNMLGKKLNDVVILQGKEYKISRIQSIWEEHGA

SEQ ID NO: 744 - protein, 149 aa, Chlamydia pneumoniae
  CPn0742
TKMMVIVMNSKSAQKIIDSIKQILTIYNIDFDPSFGSSLSSDSDADYEYLITKTQEKIQELDKRAQEILTQTGMSKEQMEVFANNPDNFSPEEWLALEKVRSSCDEYRKETENLINEITLDLHPTKESKRPKQKLSSTKKNKKKNWIPL

SEQ ID NO: 745 - protein, 469 aa, Chlamydia pneumoniae
  CPn0743
IFMKITVNRGLDLSLQGSPKESGFYNKIDPEFVSIDLRPFQPLSLKLKVEQGDAVCSGAPIAEYKHFPNTYITSHVSGVVTAIRRGNKRSLLDVIIKKTPGPTSTEYTYDLQTLSRSDLSEIFKENGLFALIKQRPFDIPAIPTQTPRDVFINLADNRPFTPSPEKHLALFSSREEGFYVFVVGVRAIAKLFGLRPHIVFRDRLTLPTQELKTIAHLHTVSGPFPSGSPSIHIHSVAPITNEKEVVFTLSFQDVLTIGHLFLKGRILHEQVTALAGTALKSSLRRYVITTKGASFSSLINLNDISDNDTLISGDPLTGRLCKKEEEPFLGFRDHSISVLHNPTKRELFSFLRIGFNKPTFTKTYLSGFFKKKRTYTNPDTNLHGETRPIIDTDIYDKVMPMRIPVVPLIKAVITKNFDLANELGFLEVCGEDFALPTLIDPSKTEMLTIVKESLIEYAKESGILTPHQD

SEQ ID NO: 746 - protein, 333 aa, Chlamydia pneumoniae
  CPn0744
EMSSLTLSRRPRRNRKTAAIRDLLAETHLSPKDLIAPFFVKYGNNIKEEIPSLPGVFRWSLDLLLKEIERLCTYGLRAVMLFPIIPDDLKDAYGSYSSNPKNILCHSIHEIKNAFPHLCLISDIALDPYTTHGHDGIFLNGEVLNDESVRIFGNIATLHAEMGADIVAPSDMMDGRIGYIRSKLDQSGYSKTSIMSYSVKYASCLYSPFRDALSSHVTSGDKKQYQMNPKNVLEALLESSLDEEEGADILMVKPAGLYLDVIYRIRQNTCLPLAAYQVSGEYAMILSAFQQGWLDKETLFHESLIAIKRAGADMIISYSAPFILELLHQGFEF

SEQ ID NO: 747 - protein, 54 aa, Chlamydia pneumoniae
  CPn0745
VDSCFDDWRASSLQGSTTYNVAYDPKHTLAYGFCNQVSVKKFHLKPPKSQEKFL

SEQ ID NO: 748 - protein, 543 aa, Chlamydia pneumoniae
  CPn0746
FSGRCPFSFEVFMLGKEEEFTCKQKQCLSHFVTNLTSDVFALKNLPEVVKGALFSKYSRSVLGLRALLLKEFLSNEEDGDVCDEAYDFETDVQKAADFYQRVLDNFGDDSVGELGGAHLAMENVSILAAKVLEDARIGGSPLEKSTRYVYFDQKVRGEYLYYRDPILMTSAFKDMFLGTCDFLFDTYSALIPQVRAYFEKLYPKDSKTPASAYATSLRAKVLDCIRGLLPAATLTNLGFFGNGRFWQNLIHKLQGHNLAELRRLGDESLTELMKVIPSFVSRAEPHHHHHQAMMQYRRALKEQLKGLAEQATFSEEMSSSPSVQLVYGDPDGIYKVAAGFLFPYSNRSLTDLIDYCKKMPHEDLVQILESSVSARENRRHKSPRGLECVEFGFDILADFGAYRDLQRHRTLTQERQLLSTHHGYNFPVELLDTPMEKSYREAMERANETYNEIVQEFPEEAQYMVPMAYNIRWFFHVNARALQWICELRSQPQGHQNYRTIATGLVREVVKFNPMYELFFKFVDYSDIDLGRLNQEMRKEPTT

SEQ ID NO: 749 - protein, 35 aa, Chlamydia pneumoniae
  CPn0747
RTCMGCKGAEVQILSSRSLSGMKILSSSLFYKKFC

SEQ ID NO: 750 - protein, 292 aa, Chlamydia pneumoniae
  CPn0748
GTLVLHALDTYRPSIESAIEKALEGFGPIGHPIRSPVEYALQGGGKRLRPGLVCMMAQGLGLNHDVMDSALAVEFVHTSTLIADDLPCMDNDDERRGRPTVHKAFDEATALLASYALIPAAYSHLRLNAKKLKEQGCDPREIDIAYNIIGDITDKNIGCSGVLGGQYDDMFFSNRGQEHVQSIMIKKTGSLFEIACISGWLFGGGDPQFAPIITSFSNNFGLLFQIKDDFSDLQKDSQQIGLNYALLFGEKAALELLARSQNNCLELLDRLSAGGLKNSSEFETIISSLGSF

SEQ ID NO: 751 - protein, 211 aa, Chlamydia pneumoniae
  CPn0749
VCYMTYLASSIFSPEDFLYPEIISKAHYTWDILDLMDQMLENHVFSGIHGTVESGVTLKNIEKIEIAEDAYVESGAYIVGPCILGSQTEVRHGAYLRGNVITGSRCVVGHCTEIKNSYLGHHTKAAHFAYLGDSVLSSEVNLGAGVRCANFRLDGRNIYVRSTSDKSKKIDTGRRKLGAFLGKGVAIGCNVVINPGQHILPHTRIRPGQVI

SEQ ID NO: 752 - protein, 253 aa, Chlamydia pneumoniae
  CPn0750
KITDFILRIHSYNLFCFHMIGDKIILFVTEDLSLSSQLKDLASQRSDYQILVSPVFPTSFESVAIFCEYLLLPEQIFSPGIFPEEDLIVLFDTFQEEAITKVLNQGATGYLLRPITAKVLDAVIRAFLRQHEVLEHSIPDTMTFGDHTFRVLNLVIESPEGSVYLTPSEAGILKKLLINRGHLCLRKNLLAEIKGNTKEIIARNVDVHIASLRKKLGPYGSKIVTIRGVGYLFSDDDSIPLQNHDNTAHPNEE

SEQ ID NO: 753 - protein, 609 aa, Chlamydia pneumoniae
  CPn0751
MFRCILFGIFLLTCFSSGGVLYYLFCSHDFSIGPKEKSRSVWIEEEKEFTDSVLHHLPSQHQHLHILCFQGFLLQKQQKFSQAEKIFSKVYDEAQDGPFLFKEEILGSRLINSFFLEKTDVMETILCLLNQRCPNSPYYHLFKALVCYKQKLYREVIEQLAYWQEEKTRALAPLLNISIEQLLTDFLLDYISAHSLIEQKMFPEGRVILNRNINRLLKHECEWNAKTYDRIAILLSRSYFLELVESKSADIYFDYYEMVLFYLKKIYILEQCPYAELLPEEELVSLIMEHVFILPKDKLYPLIQLLEMWQKHYVHPNSSLVVQILVDRFSTHMEGAIRFCEALVSFSGLEELHQQIITTFEELLSNKVQQIKTEEAKQCVALLHILDPSISISEKLALSSDTLQNIVSGDDEQHTKLRNYLDLWEAIQSYDIDRQQLVHHLVYGAKDLWKKGGNDEKALNLLQLVLRFTSYDIECESVVFLFIKQAYKQALSSHAIARLLKLEKFISEANIPSIVISEAEKANFLADAEYLFAHEDYDKCYLYSMWLTKVAPSPQSYRLAGLCLMENKRYDEALEFLCMLSPNDSINDYKTQKALAFCQKHQSKDRAAS

SEQ ID NO: 754 - protein, 496 aa, Chlamydia pneumoniae
  CPn0752
GWALHTEFAPFLEDLVHQQVISPLDIAFASKHISSDFEESFVFLAVSSALWRYGHPFLSLEENRIRPSLGGISETDLYRGFHNLPKEARDKLFVVVSGRLYLRSLYTIRSKLLDKLSLLCSATPNYFPPSIDSSILSEEQNFIFNKITQGCFSIVSGGPGTGKTFLAAQLILSLVKQQPKLRIAIVSPTGKATSHIRQILMKYNIFDDMVLMQTVHHFLQEYAYRRYNSIDVLLVDEGSMVTFDLLYSLVQTLQGYEKDKKLYTSSLIILGDTNQLPPIGIGVGNPLQDLIGYFHENTFFLKTSHRAKTGVVDQLTQSVLRGEMISFSPLPSISSAIEVLKNRFVKSLRQSEARLCVLTPMRHGPWGVLNLNTMIHQRLARSDPDLRIPIMVTSRYETWGLFNGDTGLLCLKTQKLHFPQHEPIDSRALSQYVYNYVMSVHKSQGSEYDEVIVIIPKGSEVFGVSILYTAITRAKYRVSVWGDPETLHKIIKKSNY

SEQ ID NO: 755 - protein, 283 aa, Chlamydia pneumoniae
  CPn0753
IMATAHLGRQALLHLRSWTPAIRASGNLFRQQSMSLHNNVLFAGDIVGAIKNSTAISRHALGSSHYAHAALQKTEGFLGAADGVNTAVAGAMLWGQLLNGSMIFETDEETGELRRCNEADAEGCMTQKLQRRSALTITGKVARLASKTLGTATFLHEMDVVSLGANANKIGCKVTSCLNLVATGCSLTESSISLYRILSTRPETISDPENRNKPSAEFAARSKAIRNAFIAWLGDVVDLVCDALGTLSLFLPAILGVHAVLIMAILGLISCVINFVKDYAKIG

SEQ ID NO: 756 - protein, 114 aa, Chlamydia pneumoniae
  CPn0754
QFILNLKVLVLSGDIMAPKKPNKKNVIQRRPSAEKRILTAQKRELINHSFKSKVKTIVKKFEASLKLDDTQATLSNLQSVYSVVDKAVKRGIFKDNKAARIKSKATLKVNARAS

SEQ ID NO: 757 - protein, 407 aa, Chlamydia pneumoniae
  CPn0755
YKDLFFMLLVRKWLHTCFKYWIYFLPVVTLLLPLVCYPFLSISQKIYGYFVFTTISSLGWFFALRRRENQLKTAAVQLLQTKIRKLTENNEGLRQIRESLKEHQQESAQLQIQSQKLKNSLFHLQGLLVKTKGEGQKLETLLLHRTEENRCLKMQVDSLIQECGEKTEEVQTLNRELAETLAYQQALNDEYQATFSEQRNMLDKRQIYIGKLENKVQDLMYEIRNLLQLESDIAENIPSQESNAVTGNISLQLSSELKKIAFKAENIEAASSLTASRYLHTDTSVHNYSLECRQLFDSLREENLGMLFVYARQSQRAVFANALFKTWTGYCAEDFLKFGSDIVISGGKQWMEDLHSSREECSGRLVIKTKSRGHLPFRYCLMALNKGPLCYHVLGVLYPLHKEVLQS

SEQ ID NO: 758 - protein, 596 aa, Chlamydia pneumoniae
  CPn0756
ISYLPLTKLSSKARNPLVLFQVRKLFMNTQNSQATEVSSEEESQKKLEELVALAKEQGFITYEEINEILPMSFDTPEQIDQVLIFLTGMDIQVLNQIDVERQKEKKKEAKELEGLARRTEGTPDDPVRMYLKEMGTVPLLTREEEVEISKRIEKAQVQIERIILRFRYSAKEAISIAHYLISGKERFDKIISEKEVEDKTHFLKLLPKLITLLKEEDTYLENLLLSLKQPDLSKQEAAKLNDSLEKCRIRTQAYLRCFHCRHNVTEDFGEVVFKAYDSFLHLEQQINDLKVRAERNKFAAAKLAAAKRKLYKREVAAGRTLEEFKKDVRMLQRWMDKSQEAKKEMVESNLRLVISIAKKYTNRGLSFLDLIQEGNMGLMKAVEKFEYRRGYKFSTYATWWIRQAVTRAIADQARTIRIPVHMIETINKVLRGAKKLMMETGKEPTPEELAEELGLTPDRVREIYKIAQHPISLQAEVGEGSESSFGDFLEDTAVESPAEATGYSMLKDKMKEVLKTLTDRERFVLIHRFGLLDGKPKTLEEVGSAFNVTRERIRQIEAKALRKMRHPIRSKQLRAFLDLLEEEKTGTSKVKSLKSK

SEQ ID NO: 759 - protein, 142 aa, Chlamydia pneumoniae
  CPn0757
PCIKNIALVIAIERYQLIISKFRMWLFLGCSVEERHFKQPVLISVTFSYNEVPSACLSDKLSDACCYLEVTSLIEEIANTKPYALIEHLANELFDSLVISFGDKASKIDLEVEKERPPVPNLLNPIKFTISKELCPSPVLSA

SEQ ID NO: 760 - protein, 452 aa, Chlamydia pneumoniae
  CPn0758
RAMSEPRFVCLSLGSNLGNRFKNLQIARTLLGEQAVLGLRSSVILETEALLLPGSPPEWDLPYFNSVLVGETTLSLRELLVTIKQIEKVVGRAEESPPWSPRTIDVDILLYGDESFCCDHTEITIPLSNLLSRPFLIALIASLCPYRRFCTQGSPYHNFTFGELAHHLPSPPGMIRRSLSPDTMLMGVVNVTNDSMSDGGMFLDPEKAVAQAEKLFTEGAAVIDFGAQATNPKVKQFLSVDQEWERLEPVLRLLKETWSNRKQYPIISLDTFYPEIILRAMDIYPIQWINDVSGGSQSMAEVARDCELSLVMNHSSSLPVDPKNILSFSVPIGEQLLSWGEKQLKMFSDVGLNANQVIFDPGIGFGKGAAQSLATLYEIAKFKRLGCPILIGHSRKSFLSLFGNHDPKDRDWETVGLSILLQQQGVDYLRVHNVAAHQKALSVAACEACAPI

SEQ ID NO: 761 - protein, 188 aa, Chlamydia pneumoniae
  CPn0759
LLVKPVHPSNFENPLGVEMCKNRGVRGIVACDPRGVIGLEGKLPWHYPEDLQFFSETIQKFPIVMGRKTWETLPRKYFVDRAVVVFSHEKRQGVHGEIWVTSLEEFLLLDLSSPTFLIGGGELYSLFLENQIVRDFFISHIKKEYAGDTFFPLSLLETWTKTVLRDTQKITTCYYENHHSQNTKNISL

SEQ ID NO: 762 - protein, 264 aa, Chlamydia pneumoniae
  CPn0760
RHGPKLCLEIPKRSQRVTMKITTVKTPKIYPYDDLYSILESSLPKLNERSIVVITSKIVSLCEGAVVELEKVSKDELIKQEADAYVFVEKYGIYLTKKWGILIPSAGIDESNVEGYFVLYPRDFLLSVNTLGDWLRNFYHLEHCGIIISDSHTTPLRRGTMGLGLCWNGFFPLYNYVGKPDCFGRALKMTYSNLLDGLSAAAVLCMGEGDEQTPIAIIEEAPKITFHSSPTTLQDMSTLAIAEDEDLYGPLLQSMAWETPAPTS

SEQ ID NO: 763 - protein, 226 aa, Chlamydia pneumoniae
  CPn0761
GIMTSWIELLDKQIEDQHMLKHEFYQRWSEGKLEKQQLQAYAKDYYLHIKAFPCYLSALHARCDDLQIRRQILENLMDEEAGNPNHIDLWRQFALSLGVSEEELANHEFSQAAQDMVATFRRLCDMPQLAVGLGALYTYEIQIPQVCVEKIRGLKEYFGVSARGYAYFTVHQEADIKHASEEKEMLQTLVGRENPDAVLQGSQEVLDTLWNFLSSFINSTEPCSCK

SEQ ID NO: 764 - protein, 380 aa, Chlamydia pneumoniae
  CPn0762
EELLYFSRFSEKQNYSLGNMETKRSIYMNLPDRKKALEAAVAYIEKQFGAGSIMSLGRHSATHEISTIKTGALSLDLALGIHGVPKGRVIEIFGPESSGKTTLATHIVANAQKMGGVAAYIDAEHALDPSYASLIGVNIDDLMISQPDCGEDALSIAELLARSGAVDVIVIDSVAALVPKSELEGDIGDVHVGLQARMMSQALRKLTATLSRSQTCAVFINQIREKIGVSFGNPETTTGGRALKFYSSIRLDIRRIGSIKGSDNSDIGNRIKVKVAKNKLAPPFRIAEFDILFNEGISSAGCILDLAVEYNIIEKKGSWFNYQEKKLGQGREFVREELKRNRKLFEEIEKRIYDVIAANKTPSVHANETPQEVPAQTVEA

SEQ ID NO: 765 - protein, 183 aa, Chlamydia pneumoniae
  CPn0763
NFPMTDPKIEKSALRKLFISIRRDLSEERKHEASSAVASFVRSFSKESVVLSFVSFNHEIDMQEANRILIQKCTLALPKIDQENLYPVLIPSIDDLISVVHPKDPFSKQTPISSDKITHVLVPGLAFDQQGYRLGYGHGFYDRWLAQHPYPSIRTIGIGYCEQKIDRLPQESHDIPLSQIYLC

SEQ ID NO: 766 - protein, 432 aa, Chlamydia pneumoniae
  CPn0764
GYKSMDIKKLFCLFLCSSLIAMSPIYGKTGDYEKLTLTGINIIDRNGLSETICSKEKLKKYTKVDFLAPQPYQKVMRMYKNKRGDNVSCLTAYHTNGQIKQYLECLNNRAYGRYREWHVNGNIKIQAEVIGGIADLHPSAESGWLFDQTTFAYNDEGILEAAIVYEKGLLEGSSVYYHTNGNIWKECPYHKGVPQGKFLTYTSSGKLLKEQNYQQGKRHGLSIRYSEDSEEDVLAWEEYHEGRLLKAEYLDPQTHEIYATIHEGNGIQAIYGKYAVIETRAFYRGEPYGKVTRFDNSGTQIVQTYNLLQGAKHGEEFFFYPETGKPKLLLNWHEGILNGIVKTWYPGGTLESCKELVNNKKSGLLTIYYPEGQIMATEEYDNDLLIKGEYFRPGDRHPYSKIDRGCGTAVFFSSAGTITKKIPYQDGKPLLN

SEQ ID NO: 767 - protein, 205 aa, Chlamydia pneumoniae
  CPn0765
TTIYIKLLGRLMKKWISILILSFLSLLSILPVLAITINHVKISQRWSDLNSQILTLKVIRDHEDQVIKHNARISKDRNNLSIESLNASCKQLRPLSKERERLNKLNSNSLLAQSKEVWERKRALEKSNHQLVWNCEQMHNDFAFVRLEQATEMDNEDIESLFSLFNPENPVAPLVFFTCWKMTKQTTPLGNEVWLTHAEAISRWI

SEQ ID NO: 768 - protein, 464 aa, Chlamydia pneumoniae
  CPn0766
AMNFKLPVYHIGLTKAENNTIKIAILQKTCKGWIVCHCEQIPEGKTWSLPKKYFAAPTTFSLQGSDILVKSSSSSLKNRKNILKVALTNLEASLALPWESLIVQPQLGKPTDRGETPLTLWIAQKNTLKKELSFLSQAQIFPDKLSCRAADIFFLAEQSPLKSLPAYLLIYGGSEEVTCIFVKNHAIAVARSFSNHSTKKSCDDIHATLQYIQETFPQTVLPAIHVAQISPNLQKILEQKLSLPLVVCQSMTYGVEDEDWEIYGDTIAAAHHGASRRPLTFPYDATSVSPAAQKHWLLRSSLLIGKYALMATVVVSLGSVLKLKSLSSSASNHFAFACPEEGVLPRSLKAAEKTVKAIGKKNSASNYPLLPTIPTSEQTLKFLLALGKSSPSIKFSYFSYTMTSYPSKDNPSLPYSALVEVKGQGQPEDIPQFLKKISSHPKLQHVSESLEDQRSFKLQFTLSS

SEQ ID NO: 769 - protein, 100 aa, Chlamydia pneumoniae
  CPn0767
NIMLSYLLRTAINVYSFLILAYIFASWVPDCQSARWYQLVSKCVDPFLNFFRRFVPRIGFIDPSPFVGLLCLGILPFVILRVLRFIILNIFHSPWLLQYL

SEQ ID NO: 770 - protein, 340 aa, Chlamydia pneumoniae
  CPn0768
YFSFSMAAPIFIKNILLRSSIVYAPLAGFSDYPYRCMSALYQPGLMFCEMVKVEGILYAPERTSKLLDYNENMRPIGAQLCGSNPETSGEAAKILEGLGFDLIDLNCGCPTDKITKDGSGSGLLKTPELIGRILDKIINSVSIPVTVKIRSGWDMEHINVEDTVRIIRDAGASAVFVHGRTRAQGYHGPSKQEYISRAKAAAGKEFPVFGNGDIFSPEAAQAMLTTGCDGVLVARGTLGAPWIGKQIQDYLTTGSYEKIPFIKRKAAFLEHMRLVEDYYQSETKFLSETRKLCGHYLISAAKVRFLRSSLAKATSYQEVYQLVNDYEEADDSSLETFVKC

SEQ ID NO: 771 - protein, 881 aa, Chlamydia pneumoniae
  CPn0769
SIQGPHAIRLMKKSLIIVESPAKIKTLQKLLGSEFVFASSIGHIVDLPAKEFGIDVDHDFEPQYQVLPDKQEVINHIRKLAAKCEKVYLSPDPDREGEAIAWHIANQLPDSPLIQRVSFNAITKNAVTEALKHPRTIDMALVNAQQARRLLDRIVGYKISPILSRKLQQRSGISAGRVQSVALKLVVDREKAIDAFVPVEYWNLRVLMQDPKTTKTFWAHLYAVQGKKWEKEIPEGKTENDVLLINSEEKARHYAELLEKSSYTITRVEAKAKRRFAPPPFITSTLQQEASRHFRFSASRTMSIAQTLYEGVDLDSEDSTGLITYMRTDSVRVDPEALTTVREYIQQTFGKEYLPEKANVYTTKKMTQDAHEAIRPTDINLTPDKLKNKLSDDQFKVYNLIWKRFVASQITPAIYDTLAVQITTDTEIDLRASGSLLKFKGFLAVYEEKQDDENDQEEDHPLPPLHAQDALIKEEVSQEQAFTKPLPRFTEASLVKELEKSGIGRPSTYATIMNKIQSREYTTKENQRLRPTELGKIISQFLETNFPRIMDIGFTALMEDELELIADNKKPWKLLLQEFWTTFLPVVITAEKEAVIPRILTNIECSKCHKGKLVKIWSKNSYFYGCSEYPECDYRTSEEELAFNKEDYAEDTPWDSPCPLCGGVMKVRHGRYGTFLGCEKYPECRGTISIHKKGEEIEQEEPIPCPAIGCNGKIFKKRSRYNKIFYSCSEYPECSVIGNSIDAVITKYSGTEKIPYKKKTPTKKKSSAKTTKAAKTPSKKGKAKSSVKKSSEKKTGPLFLPSPDLAKMIGNEPVSRGEATKKIWDYIKEHQLQAPENKKLLVPDNNLATIIGPNPIDMFQLSKHLSQHLTKVSNDESSASS

SEQ ID NO: 772 - protein, 270 aa, Chlamydia pneumoniae
  CPn0770
KPRTRNVEKLEFVTSLSSPDDDLITFNKQGLIAGPEEEKVAFLVRSNAMLDAGPETPASFPESLREQFDIFPEYVEVLYSNEGLDVWEAGCTWILNNEVTIQLRKHHRKASRWLGMYSRDEVLAHEAVHAVRMKFHEPVFEEVLAYQTSRWGWRRFFGPLFRSPGESYLLLFFTILGLGISLWYPAGILIMLVLPMYFLMRLCMAQSYLYRAMKKIRKMLGVPPLWVLLRLTDKEIKMFAKEPIPVLEHYARKRKLENVRWKQIYQSYFV

SEQ ID NO: 773 - protein, 456 aa, Chlamydia pneumoniae
  CPn0771
IFKGNSKRLYDSSALDMFQQKQKLSLKYLPSLRMQQGLQMLQSPLTELSSYVVQEIIDNPFFDLSSLEEEEWSPCYRPTNSTFSYLNQTPGPQESLYTRLLPQIEEAFSTAEERFIAHQIAGNLSDEGLFLRNPEDFAQELELPLEKIHKVWDTIQNLSPEGIASPSLQSYWMKLLRNSSHQQAYSIVRDCYPLMTNCEFAPIMKKFSLSLSELRNILKKALGSIPWCPAAACTVKPMVSTPLPDIYLFYSSGSWKIEVSTRGLPSIKLNKETFHFYEHLPKEEQKNLSQQILSAKWLIKNLRKREQTLLQVMETLLPKQEDFLLGKIPAPYPLGIKDLAEDLSFHESTIFRAIENKAVAAPIGIFPLKHLFPRGIHQDSSHSKENVLQWIRQWIATEQTPLSDSVISDRITAKGIPCARRTVAKYRAQLKILPANKRKKLFYIRSSNSHFRDRQF

SEQ ID NO: 774 - protein, 644 aa, Chlamydia pneumoniae
  CPn0772
KLGLIMTCISELNEAQRKAVTAPLNPVLVLAGAGAGKTRVVTYRILHLINQGIAPREILAVTFTNKAARELKERIVNQCASTNEFDVPMVCTFHSLGVFILRRSINLLNRENNFTIYDQSDAEKLIKHALQQHNLKPNLASKIQAHVSQAKNRLLFPEDLDPNDYIDPVVSIYQEYQKKLIEANALDFDDLLFLTVRLLRESPEAQELYNQLWKALLIDEYQDTNHAQYTLMQLLSKQHRNVFAVGDPDQSIYSWRGANIHNILNFENDYPNAKVLCLEENYRSYGNILNAANALIKNNASRLEKELRSVKGPGEKIRLFLGSTDREEADFVAAEILQLHRVGNIKLRDICIFYRTNSQSRTFEDALLRRRIPYEIIGGLSFYKRKEIQDILAFLRIFISKSDIVAFDRTVNLPKRGIGSTTIFALTQYAIAQGLPILKACQQALDTKDVKLSKKQQEGLQEYLALFPQIEHAYNTLSLRDFIESVVRITGYLEILKEDADTFKDRKSNLEELYHKALESEQQNPKTHLELFLDDLALKGSDDDLNLTADRVNLMTLHNGKGLEFRVSFLVGLEEQLLPHANSLGGTYENIEEERRLCYVGITRAQDLLYLTAAQVRSLWGTVRMMKPSRFLKEIPKDYMIQVR

SEQ ID NO: 775 - protein, 237 aa, Chlamydia pneumoniae
  CPn0773
FMQNATIDQLPVSWQEQLPLCWREQLKEEWSKPYMQQLLIFLKQEYKEHTVYPEENCVFSALRSTPFDQVRVVILGQDPYPGKGQAHGLSFSVPEGQRLPPSLINIFRELKTDLGIENHKGCLQSWANQGILLLNTVLTVRAGEPFSHAGKGWELFTDAIVTKLIQERTHIIFVLWGAAARKKCELLFNSKHQHAVLSSPHPSPLAAHRGFFGCSHFSKINYLLNKLNKPMINWKLP

SEQ ID NO: 776 - protein, 81 aa, Chlamydia pneumoniae
  CPn0774
LEAPMNEGIHSVCFQKTPRLTAKSVVSMEMLLTTQQLPSAEGMPSVANLEADFLRAEALLAEMREIRGCLEQSLRTLVPSE

SEQ ID NO: 777 - protein, 209 aa, Chlamydia pneumoniae
  CPn0775
ERFMKIVIASSHGYKIRETKTFLKRLGDFDIFSLSDFPDYKLPQEQGDSITANALTKGIHAANHLGCWVIADDTMLRVPALNGLPGPLSANFAGVGAYDKDHRKKLLDLMSSLESLVDRSAYFECCVVLVSPNQEIFKTYGICEGYISHQEKGSSGFGYDPIFVKYDYKQTFAELSEDVKNQVSHRAKALQKLAPHLQSLFEKHLLTRD

SEQ ID NO: 778 - protein, 436 aa, Chlamydia pneumoniae
  CPn0776
FIFVLKNFYDCLLMFFQFLSFTMKKIFYSFVLLSCIFPYVGCAQVFVGLDRIFSEGEYTRCIQGKKIALISHSAAINSRGQDALSVFYSRKHDCTVEILCTLEHGYYGATPTETVGNQPSRYPNLRSVSLYGVKEVPKEVAEHCDVFVYDVQDIGVRSYSFVTVLMQIVKASERYGKQLIVLDRPNPMGGRIVDGPLPNPTTSGSLAIPYCYGMTPGELALFFKKTYAPNANVVVIPMKGWNRSMTFDETGLIWMPTSPQMPDPQSPFFYAATGILGALSVASIGVGYTLPFKVLGAPWMDGEKVADELNRMKLPGVLFLPFFYEPFFGKYKMEMCSGVLLVLQDPKIFYPVETQCTIWGVLKALYPKQVEQTLKSIERIPARRSSICNLFGGDEFLSISHKERYIVWPLRRLCKESRESFHQLRSSCLLSEYAES

SEQ ID NO: 779 - protein, 531 aa, Chlamydia pneumoniae
  CPn0777
TSEDRVVWVFKSQFEGLSALKRGVHALTKAVTPAFGPRGYNVVIKKGKAPIVLTKNGIRIAKEIILQDAFESLGVKLAKEALLKVVEQTGDGSTTALVVIDALFTQGLKGIAAGLDPQEIKAGILLSVEMVYQQLQRQAIELQSPKDVLHVAMVAANHDVTLGTVVATVISQADLKGVFSSKDSGISKTRGLGKRVKSGYLSPYFVTRPETMDVVWEEALVLILSHSLVSLSEELIRYLELISEQNTHPLVIIAEDFDQNVLRTLILNKLRNGLPVCAVKAPGSRELRQVVLEDLAILTGATLIGQESENCEIPVSLDVLGRVKQVMITKETFTFLEGGGDAEIIQARKQELCLAIARSTSESECQELEERLAIFIGSIPQVQITADTDTEQRERQFQLESALRATKAAMKGGIVPGGGVAFLRAAHAIEVPANLSSGMTFGFETLLQAVRTPLKVLAQNCGRSSEEVIHTILSHENPRFGYNGMTDTFEDLVDAGICDPLIVTTSSLKCAVSVSCLLLTSSFFISSRTKT

SEQ ID NO: 780 - protein, 231 aa, Chlamydia pneumoniae
  CPn0778
APVAQSDRVPGYEPGGQRFESSLVRNNKRVEEEVFMTLSLVGKEAPDFVAQAVVNGETCTVSLKDYLGKYVVLFFYPKDFTYVCPTELHAFQDALGEFHTRGAEVIGCSVDDIATHQQWLATKKKQGGIEGITYPLLSDEDKVISRSYHVLKPEEELSFRGVFLIDKGGIIRHLVVNDLPLGRSIEEELRTLDALIFFETNGLVCPANWHEGERAMAPNEEGLQNYFGTID

SEQ ID NO: 781 - protein, 136 aa, Chlamydia pneumoniae
  CPn0779
RFDLIFQMKFTVALFGEAEKGSYDTAYFCRSLVDLHNYLGDVSSPGITLAIKTLLSDYNVVYFRVREEGYCVDSYFFGLHFLNTQTTLKNIIAIGLPGVGNQHIIEASRSLCQKHNSLLLFFDHDLYDLLTFNQPF

SEQ ID NO: 782 - protein, 217 aa, Chlamydia pneumoniae
  CPn0780
HGNKIAVQSLRFMHAKLSFFILLSLLFSGIDCSRLHAAGRSPSLQGVLAEIEDISAKLASHEVEIVMLSERLDEQDSKCQKWTAAKPETLAQKIRELESDQKALAKTLAVLTTSVKDLQTNLQSKLQEIQKDHRALAQDLRLVRRSLLALVDSSSPGAYADFSDPVPENIYIVREGDSLSKIAKKYKLSVTELKKINKLDSDAIYAGQRLCLQRNKQ

SEQ ID NO: 783 - protein, 218 aa, Chlamydia pneumoniae
  CPn0781
QNCYRSRRKTVPLLGCFPSATDKENTMNIHSLWKLCTLLALLALPACSLSPNYGWEDSCNTCHHTRRKKPSSFGFVPLYTEEDFNPNFTFGEYDSKEEKQYKSSQVAAFRNITFATDSYTIKGEENLAILTNLVHYMKKNPKATLYIEGHTDERGAASYNLALGARRANAIKEHLRKQGISADRLSTISYGKEHPLNSGHNELAWQQNRRTEFKIHAR

SEQ ID NO: 784 - protein, 435 aa, Chlamydia pneumoniae
  CPn0782
GDIGMLRQLCFQVFFFCFASLVYAEELEVVVRSEHITLPIEVSCQTDTKDPKIQKYLSSLTEIFCKDIALGDCLQPTAASKESSSPLAISLRLHVPQLSVVLLQSSKTPQTLCSFTISQNLSVDRQKIHHAADTVHYALTGIPGISAGKIVFALSSLGKDQKLKQGELWTTDYDGKNLAPLTTECSLSITPKWVGVGSNFPYLYVSYKYGVPKIFLGSLENTEGKKVLPLKGNQLMPTFSPRKKLLAFVADTYGNPDLFIQPFSLTSGPMGRPRRLLNENFGTQGNPSFNPEGSQLVFISNKDGRPRLYIMSLDPEPQAPRLLTKKYRNSSCPAWSPDGKKIAFCSVIKGVRQICIYDLSSGEDYQLTTSPTNKESPSWAIDSRHLVFSAGNAEESELYLISLVTKKTNKIAIGVGEKRFPSWGAFPQQPIKRTL

SEQ ID NO: 785 - protein, 263 aa, Chlamydia pneumoniae
  CPn0783
IMMKYLPYIAITACIHGGILLLVFASPLPKKRLQPKAFQEKLVTIQPKPPVPTPSVVVDPAKTIRPSVATQPQKQAKCSPPQENVQKALQKPIPKVIKTEPPKPSPAPTVAKKTTATEKPPPSTTKKNTQLSKTQLQTLSEVAQALSLHVDKIEKSETSLKNISWPSTAQLTMHSELKATQEDELCELFRTHIALPSKGYVRIKLVLSPNGEIQECSFLSEVSAADKQLLTQRIQALPFQKFLEKYKVSKNISFHIKLVSNES

SEQ ID NO: 786 - protein, 156 aa, Chlamydia pneumoniae
  CPn0784
DRADSIFTTEFYRSQIPQYKLMKYRFTEEIEEEPLVNLTPLIDIVFVILMAFIVAVPLIKLDSIALAPGTQEQEVLSSENDSIAVIKVFADHSLTLNEHPITLQELTVRLTLLHKAYPEKTPLLLQDGETSFRTYQNVKNAIEAAGFHELHVALQN

SEQ ID NO: 787 - protein, 248 aa, Chlamydia pneumoniae
  CPn0785
DHLYFETLSVNKDFYSMVHFSHNPIIQAYTEADFFGKSIFFCLLILSVCTWTVLHQKLAIQKNFLKAGKSLKDFLIKNRHAPLSLDIHPELSPFADLYFTIKRGTLELLDKNRQSAPDRGPILSSEDIQSLETLLGAIMPKYKALLHKNSFIPATTISLAPFLGLLGTVWGILVAFTHISSGSSGNSAIMEGLATALGTTIIGLFVAIPSLIAFNYLKAHSSELISEIEQTAYLLLNSIEVKYRNTNL

SEQ ID NO: 788 - protein, 719 aa, Chlamydia pneumoniae
  CPn0786
NHGVILNKFKTYLQTALIAPFFSFPALSGSFSSIQAEEITQQVNHPGAELLSEGSYIPGLQTFRLGIKITASKGSHIYWKNPGEIGSPLKISWQLPKGFVVEEEHWPTPKVFEEEGTTFFGYEDSALIVADVRAPEGYTPGQEVELRAQVEWLACGDSCLPGNVDLKLTLPYEEKEPSLYPDTHAEFTKTLHAQPRVLENDHSVQVAQGKGNEIILNISKKINATKAWFVSEKADKLFAYAETSYSGGTGTAWRLKVKNLSGVQKNEKLHGILLLADHTGRPVESLTIHSEVLGQTGSAVAGLSQYITILIMAFLGGVLLNIMPCVLPLVTLKVYGLIKSAGEHRSSVIANGLWFTLGVVGCFWGLAGVAFILKVLGHNIGWGFQLQEPMFVATLIIVFFLFALSSLGLFEMGTMFANLGGKLQSSEMKSSNNKAVGAFFNGILATLVTTPCTGPFLGSVLGLVMSLSFLQQLLIFTAIGLGMASPYLVFSVFPKMLSVLPKPGGWMSTFKQLTGFMLLVTVTWLVWIFGSETSTTSVVVLLGGLWLAGLGAWILGRWGTPVSPKKQRVCASLLFFAFLGGAISVSGLASHYFAEPQQTVSVNEDSLWQPFSLEKLAQLRAQGRPVFVNFTAKWCLTCQMNKPVLYGDAVQKMFETHGIVTLEADWTRKDPGITEELARLGRASVPSYVYYPGDNSAPVVLPEKITQNLLEDVVSRFVR

SEQ ID NO: 789 - protein, 266 aa, Chlamydia pneumoniae
  CPn0787
TRRQPVDLADAHVHLSDDAFEEDINSVLQRAQDSGVSLVVNVTTTEKELNRSFAYAERFPKIRFCHVGGTPPQDVDQDIEEDYRNFHAAAHSKKLAAIGEVGLDYCFATEEGIARQKEVLQRYLALSLECELPLVVHCRGAFNDFFRMLDQYYHNDPRSRPGMLHCFTGTLEEAQELISRGWFISISGIVTFKNAQDLRDLVVELPLEHLLIETDAPFLAPVPYRGKKNEPAHVLHTINAVANVKGMFPQELAALAYKNVLRFLHG

SEQ ID NO: 790 - protein, 304 aa, Chlamydia pneumoniae
  CPn0788
SLVKSLRMSRHEICPEVSHKKGKYYSTFIFRCIHSLAGIAFTFFLCEHLFTNMLASSYFSQGKGFVAMVNGFHKIPGLKIIEVAGLVLPFLCHAIIGIVYLFQGKSNCYSGDGSRPHLRYAKNYSYTWQRWTAWILLFGIAFHVVHLRFIRYPVHVDIHGTTYYAVDIQPSRYDVIVRGTKGFLTLNLPNTEASSIEVSRHDLGGADAALLSERNSYLLTPSAGTAFLYVVRDALGSLFIALLYTILVIAAAFHGFNGLWTFCCRWGVVVSLRMQGVLRIVCYLAMIVVTFMGVSAVWNLYSVA

SEQ ID NO: 791 - protein, 627 aa, Chlamydia pneumoniae
  CPn0789
QMDENRKVIVVGGGLAGLSAAMQLANLGIIVELVSLTKVKRSHSVCAQGGINAALNLKPEEEDSPYVHAYDTIKGGDFLADQPPVLEMCLAAPRIIKMLDNFGCPFNRGPSGNLDVRRFGGTLYHRTVFCGASTGQQLMYTLDEQVRRREHAGRVIKRENHEFVRLVTDHSGRACGIILMNLFNNRLEILRGDAVIIATGGPGVIFKMSTNSTFCTGAANGRLFLQGMAYANPEFIQIHPTAIPGRDKLRLISESVRGEGGRVWVPGDSSKRIVFPDGSERPCGETGAPWYFLEDMYPAYGNLVSRDVGARAILRVCEAGLGIDGRMEAYLDVTHLPEKTRHKLEVVLDIYKKFTGEDPNTVPMRIFPAVHYSMGGAWVDWPAADDPDRDSRFRQMTNIPGCFNCGESDFQYHGANRLGANSLLSCLFAGLVSGDEASRFIEAFGASQATSSDFDRALQQEKEENARLLSASGKENIFVLHEEIAKIMVRNVTVKRNNRDLQETMDKLKEFRERLKNVSVLDSSPFANKSFHFVRQMGPMLELALAITKGALLRNEFRGSHYKPEFPERDDEHWLKTTVAVYAPEEPEISYLPVDTRHVAPTLRDYTKSSTGKIELTNIPDNIRLPI

SEQ ID NO: 792 - protein, 275 aa, Chlamydia pneumoniae
  CPn0790
NSRIFLIISVYPYRKREMMENLETFILKIYRGVPGKQYWESFELPLHPGENVISALMEIEKRPVNILGEKVNPVVWEQGCLEEVCGSCSILVNGVPRQACTALIQEYIDATQSREIVLAPLTKFPLIRDLIVDRSIMFDNLERIQGWVAADIEGETFGPQVTQEQQELLYALSQCMTCGCCTEACPQIDNKSDFIGPAAISQARYFNTYPGDKRSKKRWRALMGKGGIEGCGQAHNCVRVCPKKLPLTESISAVGREISKFSLRSLFSALFKKKK

SEQ ID NO: 793 - protein, 998 aa, Chlamydia pneumoniae
  CPn0791
TCLRSSRKIVVEDISDRNMYSCYSKGISHNYLLHPMSRLDIFVFDSLIANQDQNLLEEIFCSEDTVLFKAYRTTALQSPLAAKNLNIARKVANYILADNGEIDTVKLVEAIHHLSQCTYPLGPHRHNEAQDREHLLKMLKALKENPKLKESIKTLFVPSYSTIQNLIRHTLALNPQTILSTIHVRQAALTALFTYLRQDVGSCFATAPAILIHQEYPERFLKDLNDLISSGKLSRIVNQREIAVPINLSGCIGELFKPLRILDLYPDPLVKLSSSPGLKKAFSAANLIETLGDSEAQIQQLLSHQYLMQKLQNVHETLTANDIIKSTLLHYYQLQESTVRAIFFKEGLFSKEQVAFSTQHPRELSEIQRVYHYLHAYEEAKSAFIHDTQNPLLKAWEYTLATLADASQPTISNHIRLALGWKSEDPHSLVSLVTHFVEEEVENIRILVQQCEQTYHEARSQLEYIEGRMRNPLNNQDSQILTMDHMRFRQELNKALYEWDSAQEKAKKFLHLPEFLLSFYTKQIPLYFRSSYDAFIQEFAHLYANAPAGFRILFTHGRTHPNTWSPIYSINEFIRFLSEFFTSTESELLGKHAVINLEKETSRLVHNITAMLHTDVFQEALLTRILEAYQLPVPPSILNHLDQLSQTPWVYVSGGTVDTLLLDYFESSEPLTLTEKHPENPHELAAFYADALKDLPTGIKSYLEEGSHSLLSSSPTHVFSIIAGSPLFREAWDNDWYSYTWLRDVWVKQHQDFLQDTILPQLSIYAFIENFCNKYALQHVVHDFHDFCSDHSLTLPELYDKGSRFLSSLFTKDKTVALIYIRRLLYLMVREVPYVSEQQLPEVLDNVSSYLGISSRITYEKFRSLIEETIPKMTLLSSADLRHIYKGLLMQSYQKIYTEEDTYLRLTTAMRHHNLAYPAPLLFADSNWPSIYFGFILNPGTTEIDLWKFNYAGLQGQPLDNIQELFATSRPWTLYANPIDYGMPPPPGYRSRLPKEFF

SEQ ID NO: 794 - protein, 616 aa, Chlamydia pneumoniae
  CPn0792
RHHLINIKGIRIMKHTFTKRVLFFFFLVIPIPLLLNLMVVGFFSFSAAKANLVQVLHTRATNLSIEFEKKLTIHKLFLDRLANTLALKSYASPSAEPYAQAYNEMMALSNTDFSLCLIDPFDGSVRTKNPGDPFIRYLKQHPEMKKKLSAAVGKAFLLTIPGKPLLHYLILVEDVASWDSTTTSGLLVSFYPMSFLQKDLFQSLHITKGNICLVNKYGEVLFCAQDSESSFVFSLDLPNLPQFQARSPSAIEIEKASGILGGENLITVSINKKRYLGLVLNKIPIQGTYTLSLVPVSDLIQSALKVPLNICFFYVLAFLLMWWIFSKINTKLNKPLQELTFCMEAAWRGNHNVRFEPQPYGYEFNELGNIFNCTLLLLLNSIEKADIDYHSGEKLQKELGILSSLQSALLSPDFPTFPKVTFSSQHLRRRQLSGHFNGWTVQDGGDTLLGIIGLAGDIGLPSYLYALSARSLFLAYASSDVSLQKISKDTADSFSKTTEGNEAVVAMTFIKYVEKDRSLELLSLSEGAPTMFLQRGESFVRLPLETHQALQPGDRLICLTGGEDILKYFSQLPIEELLKDPLNPLNTENLIDSLTMMLNNETEHSADGTLTILSFS

SEQ ID NO: 795 - protein, 640 aa, Chlamydia pneumoniae
  CPn0793
SAVIPMIPFTKTIGFRLWLACAVAIIAPLGINIVWLNLDQYRTIVSAISTALKENAAFKANTLTQIVPLNVDVLSLFSDVLDLDAGIPETPNVLLSNEMQKVFQGIYNEISLIKVFPNGDKIVVASSIPEHLGENYNHKIDIPKNTPFLAALKQSPKNQEVFSVMQANVFDAKTQELQGILYTTFSAESLLKDLLINKQSYLTVKTAILSKYGVILKASDPALHLHTVYPDMTKEKFCQVFLNDDPCPIDSELGPLTLSPLDIGENFYSFKIKDTEIWGCIENVPSIDIAVLSYAKKEESFAPLWRRARMYTAYFFCILLGSLIAFIVARRLSLPIRKLATAMIESRKNKNCLYTDDSLGFEINRLGHIFNAMVENLHKQQHLAKTNFEMKENAQNALHLGEQAQQRLLPNTLPSYPHIELAKAYIPAITVGGDFFDVFVVGEGSKARLFLIVADASGKGVNACGYSLFLKNMLRTFLSRSSSLQQAIQETSRLFYNNTKNSGMFVTLCVYCYHQTSNTMEYYSCGHPPACYLDPDGETSWLFHPGMALGFLPEVANITSKLFHPKPGSLFVLYSDGITEAHNNNNDMFGEERLQAAIQGLTGKSAADAVHRLMLSVKTFVGNSHQHDDITLLILKVLES

SEQ ID NO: 796 - protein, 294 aa, Chlamydia pneumoniae
  CPn0794
KSSKHRSFLLKKSGGNQVSLYQKWWNSQLKKSLCYSTVAALIFMIPSQESFADSLIDLNLGLDPSVECLSGDGAFSVGYFTKAGSTPVEYQPFKYDVSKKTFTILSVETANQSGYAYGISYDGTITVGTCSLGAGKYNGAKWSADGTLTPLTGITGGTSHTEARAISKDTQVIEGFSYDASGQPKAVQWASGATTVTQLADISGGSRSSYAYAISDDGTIIVGSMESTITRKTTAVKWVNNVPTYLGTLGGDASTGLYISGDGTVIVGAANTATVTNGNQESHAYMYKDNQMKD

SEQ ID NO: 797 - protein, 396 aa, Chlamydia pneumoniae
  CPn0795
GTLGGANSSATGVSSDGSVIVGQAQTADKSVHAFQYYNGEMKDLGTLGGTSSTAKTVSPDGKVIMGRSQIADGSWHAFMCHTDFSSNNVLFDLDNTYKTLRENGRQLNSIFNLQNMMLQRASDHEFTEFGRSNIALGAGLYVNALQNLPSNLAAQYFGIAYKIRPKYRLGVFLDHNFSSHVPNNFNVSHNRLWMGAFIGWQDSDALGSSVKVSFGYGKQKATITREQLENTEAGSGESHFEGVAAQIEGRYGKSLGGHVRVQPFLGLQFVHITRKEYTENAVQFPVHYDPIDYSTGVVYLGIGSHIALVDSLHVGTRMGMEQNFAAHTDRFSGSIASIGNFVFEKLDVTHTRAFAEMRVNYELPYLQSLNLILRVNQQPLQGVMGFSSDLRYALGF

SEQ ID NO: 798 - protein, 687 aa, Chlamydia pneumoniae
  CPn0796
SELYSSYLQPCLNMSIVRNSALPLPCLSRSETFKKVRSHMKFMKVLTPWIYRKDLWVTAFLLTAIPGSFAHTLVDIAGEPRHAAQATGVSGDGKIVIGMKVPDDPFAITVGFQYIDGHLQPLEAVRPQCSVYPNGITPDGTVIVGTNYAIGMGSVAVKWVNGKVSELPMLPDTLDSVASAVSADGRVIGGNRNINLGASVAVKWEDDVITQLPSLPDAMNACVNGISSDGSIIVGTMVDVSWRNTAVQWIGDQLSVIGTLGGTTSVASAISTDGTVIVGGSENADSQTHAYAYKNGVMSDIGTLGGFYSLAHAVSSDGSVIVGVSTNSEHRYHAFQYADGQMVDLGTLGGPESYAQGVSGDGKVIVGRAQVPSGDWHAFLCPFQAPSPAPVHGGSTVVTSQNPRGMVDINATYSSLKNSQQQLQRLLIQHSAKVESVSSGAPSFTSVKGAISKQSPAVQNDVQKGTFLSYRSQVHGNVQNQQLLTGAFMDWKLASAPKCGFKVALHYGSQDALVERAALPYTEQGLGSSVLSGFGGQVQGRYDFNLGETVVLQPFMGIQVLHLSREGYSEKNVRFPVSYDSVAYSAATSFMGAHVFASLSPKMSTAATLGVERDLNSHIDEFKGSVSAMGNFVLENSTVSVLRPFASLAMYYDVRQQQLVTLSVVMNQQPLTGTLSLVSQSSYNLSF

SEQ ID NO: 799 - protein, 381 aa, Chlamydia pneumoniae
  CPn0797
VLILTWINVLTKLGLNMSKKIKVLGHLTLCTLFRGVLCAAALSNIGYASTSQESPYQKSIEDWKGYTFTDLELLSKEGWSEAHAVSGNGSRIVGASGAGQGSVTAVIWESHLIKHLGTLGGEASSAEGISKDGEVVVGWSDTREGYTHAFVFDGRDMKDLGTLGATYSVARGVSGDGSIIVGVSATARGEDYGWQVGVKWEKGKIKQLKLLPQGLWSEANAISEDGTVIVGRGEISRNHIVAVKWNKNAVYSLGTLGGSVASAEAISANGKVIVGWSTTNNGETHAFMHKDETMHDLGTLGGGFSVATGVSADGRAIVGFSAVKTGEIHAFYYAEGEMEDLTTLGGEEARVFDISSEGNDIIGSIKTDAGAERAYLFHIHK

SEQ ID NO: 800 - protein, 349 aa, Chlamydia pneumoniae
  CPn0798
VVFEIIFVVRVPMKKTCCQNYRSIGVVFSVVLFVLTTQTLFAGHFIDIGTSGLYSWARGVSGDGRVVVGYEGGNAFKYVDGEKFLLEGLVPRSEALVFKASYDGSVIIGISDQDPSCRAVKWVNGALVDLGIFSEGMQSFAEGVSSDGKTIVGCLYSDDTETNFAVKWDETGMVVLPNLPEDRHSCAWDASEDGSVIVGDAMGSEEIAKAVYWKDGEQHLLSNIPGAKRSSAHAVSKDGSFIVGEFISEENEVHAFVYHNGVIKDIGTLGGDYSVATGVSRDGKVIVGHSTRTDGEYRAFKYVDGRMIDLGTLGGSASFAFGVSDDGKTIVGKFETELGECHAFIYLDD

SEQ ID NO: 801 - protein, 354 aa, Chlamydia pneumoniae
  CPn0799
KREENMAAIKQILRSMLSQSSLWMVLFSLYSLSGYCYVITDKPEDDFHSSSAVKWDHWGKTTLSRLSNKKASAKAVSGTGATTVGFIKDTWSRTYAVRWNYWGTKELPTSSWVKKSKATGISSDGSIIAGIVENELSQSFAVTWKNNEMYLLPSTWAVQSKAYGISSDGSVIVGSAKDAWSRTFAVKWTGHEAQVLPVGWAVKSVANSVSANGSIIVGSVQDASGILYAVKWEGNTITHLGTLGGYSAIAKAVSNNGKVIVGRSETYYGEVHAFCHKNGVMSDLGTLGGSYSAAKGVSATGKVIVGMSTTANGKLHAFKYVGGRMIDLGEYSWKEACANAVSIDGEIIVGVQSE

SEQ ID NO: 802 - protein, 434 aa, Chlamydia pneumoniae
  CPn0800
RKEIKIMFEAVIADIQAREILDSRGYPTLHVKVTTSTGSVGEARVPSGASTGKKEALEFRDTDSPRYQGKGVLQAVKNVKEILFPLVKGCSVYEQSLIDSLMMDSDGSPNKETLGANAILGVSLATAHAAAATLRRPLYRYLGGCFACSLPCPMMNLINGGMHADNGLEFQEFMIRPIGASSIKEAVNMGADVFHTLKKLLHERGLSTGVGDEGGFAPNLASNEEALELLLLAIEKAGFTPGKDISLALDCAASSFYNVKTGTYDGRHYEEQIAILSNLCDRYPIDSIEDGLAEEDYDGWALLTEVLGEKVQIVGDDLFVTNPELILEGISNGLANSVLIKPNQIGTLTETVYAIKLAQMAGYTTIISHRSGETTDTTIADLAVAFNAGQIKTGSLSRSERVAKYNRLMEIEEELGSEAIFTDSNVFSYEDSEE

SEQ ID NO: 803 - protein, 661 aa, Chlamydia pneumoniae
  CPn0801
IIFTMTFQLHAPFAPCGDQPEAIARLSAGVRNQVKSQVLLGTTGSGKTFTIANVVANVNLPTLVLAHNKTLAAQLYQEFREFFPNNAVEYFISYYDYYQPEAYIARSDTYIEKSLLINDEIDKLRLSATRSILERRDTLIVSSVSCIYGIGSPENYTSMALVLEVGKEYPRNILTAQLVKMHYQASPIPQRSAFRERGSVIDIFPAYESELALRLEFLNDTLTSIEYSDPLTMIPKESVPSATLYPGSHYVIPEAIREQAIRTIQEELEERMAFFDDRPIEKDRIFHRTTHDIEMIKEIGFCKGIENYSRHFTGAPPGAPPTCLLDYFPEDFLLIIDESHQTLPQIRAMYRGDQSRKQSLVEYGFRLPSAFDNRPLTYEEAQKYFRKVIYVSATPGDTEVQESSGHIVQQIIRPTGIPDPMPEIRPATGQVDDLLEEIRLRLSQKHEKILVISITKKLAEDMAGFLSELEIPAAYLHSGIETAERTQILTDLRSGVIDVLIGVNLLREGLDLPEVSLVAILDADKEGFLRSTSSLIQFCGRAARNINGKVIFYADQKTRSIEETLRETERRRQIQLDYNKEHNIVPKPIIKAIFANPILQTSKDSESPKESQRPLSKEDLEEQIKKYEALMQRAAKEFRFNEAAKYRDAMQACKEQLLYLF

SEQ ID NO: 804 - protein, 351 aa, Chlamydia pneumoniae
  CPn0802
STSIADVMNKKKRVLTGDRPTGKLHLGHWVGSIKNRLELQNSPEYDCFFIIADLHTLTTKIRKEEVLDVDNHIYEVLADWLSVGIDPTKSIIYLQSAIPEIYELHLLFSMLISINRVMGIPSLKDMARNASIEEGSLSYGLIGYPILQSADILLAKAQFVPVGKDNEAHVELTRDIARNFNRLYGQVFPEPEVLQGELTSLVGIDGQGKMSKSANNAIYLSDSDATITEKVRKMYTDPNRIRATTPGRVEGNPLFIYHDIFNPHKDEVEEFKARYRQGCIKDIEVKARLAEELIHFLKPIKERRSEFLSKPLALQNVLEDGTHKMREVAKVTMEEVHDKFGFSHKWRSLLK

SEQ ID NO: 805 - protein, 185 aa, Chlamydia pneumoniae
  CPn0803
FMAAKTKTLELEDNVFLLLEGNLKRIFATPIGYTTFREFQNVVFNCANGQQEIANFFFEMLINGKLTQELAPQQKQAAHSLIAEFMMPIRVAKDIHERGEFINFITSDMLTQQERCIFLNRLARVDGQEFLLMTDVQNTCHLIRHLLARLLEAQKNPVGEKNLQEIQEEITSLKNHFDELTKALQ

SEQ ID NO: 806 - protein, 255 aa, Chlamydia pneumoniae
  CPn0804
EIFSSMGNLKTLLESRFKKNTPTKMEALARKRMEGDPSPLAVRLSNPTLSSKEKEQLRHLLQHYNFREQIEEPDLTQLCTLSAEVKQIHHQSVLLHGERITKVRDLLKSYREGAFSSWLLLTYGNRQTPYNFLVYYELFTLLPEPLKIEMEKMPRQAVYTLASRQGPQEKKEEIIRNYRGERKSELLDRIRKEFPLVETDCRKTSPVKQALAMLTKGSQILTKCTSLSSDEQIILEKLIKKLEKVKSNLFPDTKV

SEQ ID NO: 807 - protein, 260 aa, Chlamydia pneumoniae
  CPn0805
GYASRMKTIAVNSFKGGTAKTSTTLHLGAALAQYHQARVLLIDFDAQANLTSGLGLDPDCYDSLAVVLQGEKEIQEVIRPIQDTQLDLIPADTWLERIEVSGNLAADRYSHERLKYVLGSVQDKYDYVIIDTPPSLCWLTESALIAADYALICATPEFYSVKGLERLAGFIQGISARHPLTILGVALSFWNCRGKNNSAFAELIHKTFPGKLLNTKIRRDITVSEAAIHGKPVFATSPSARASEDYFNLTKELLILLRDI

SEQ ID NO: 808 - protein, 650 aa, Chlamydia pneumoniae
  CPn0806
NANNESPPNMEAWNKMIQVTCDQKNYEVLEGTTAAELAKQLKNSHQFIGVLINERPRDLSTHLNEGDTLVFLTSEDPEGREIFLHTSAHLLAQAVLRLWPDAIPTIGPVIDHGFYYDFANLSISESDFPLIEDTVKQIVDEKLAISRFTYGDKQQALAQFPQNPFKTELIRELPENEEISAYSQGEFFDLCRGPHLPSTAHVKAFKVLRTSAAYWRGDPSRESLVRIYGTSFPTSKELRAHLEQIEEAKKRDHRVLGAKLDLFSQQESSPGMPFFHPRGMIVWDALIRYWKQLHTAAGYKEILTPQLMNRQLWEVSGHWDNYKANMYTLQIDDEDYAIKPMNCPGCMLYYKTRLHSYKEFPLRVAEVGHVHRQEASGALSGLMRVRAFHQDDAHVFLTPEQVEEETLNILQLVSTLYGTFGLEYHLELSTRPEKDTIGDDSLWELATDALNRALVQSGTPFIVRPGEGAFYGPKIDIHVKDAIQRTWQCGTIQLDMFLPERFELEYTTAQGTKSVPVMLHRALFGSIERFLGILIENFKGRFPLWLSPEQVRIITVADRHIPRAKELEEAWKRLGLVVTLDDSSESVSKKIRNAQNMQVNYMITLGDHEINENVLAVRTRDNRVINDVSVERFLNTILEEKNSLSLTALL

SEQ ID NO: 809 - protein, 310 aa, Chlamydia pneumoniae
  CPn0807
TLQTGLHMSLFLVFLTAFIWSSSFALSKLVMNASAPIFATGARMVIAGAILALAAWFRGGFVGISKKIFLYIVLLALTGFYLTNIFEFIGLQSLSSSKTCFIYGLSPLMSALFSYIQLKEKVTLKKVLGLSLGLVSYICYLTFGGGGDDSQPWTWQIGLPELLILGAASLASFGWTLLRQIEKQSTLSVTAINAYAMLIAGMLSIMHSAVVEPWRPLPVQDISQFLYATLALVVISNLICYNLYAKLLRKYSSTFLSFCNLVMPLYSGFYGWILLGEKGVSLGLVLAVAFMVAGCRLIYHEEFRQGYIVS

SEQ ID NO: 810 - protein, 481 aa, Chlamydia pneumoniae
  CPn0808
LKKLPSWALKSLKRMPQSAEPSLAHIKPIIFKGACIAMTSGVSGSSSQDPTLAAQLAQSSQKAGNAQSGHDTKNVTKQGAQAEVAAGGFEDLIQDASAQSTGKKEATSSTTKSSKGEKSEKSGKSKSSTSVASASETATAQAVQGPKGLRQNNYDSPSLPTPEAQTINGIVLKKGMGTLALLGLVMTLMANAAGESWKASFQSQNQAIRSQVESAPAIGEAIKRQANHQASATEAQAKQSLISGIVNIVGFTVSVGAGIFSAAKGATSALKSASFAKETGASAAGGAASKALTSASSSVQQTMASTAKAATTAASSAGSAATKAAANLTDDMAAAASKMASDGASKASGGLFGEVLNKPNWSEKVSRGMNVVKTQGARVASFAGNALSSSMQMSQLMHGLTAAVEGLSAGQTGIEVAHHQRLAGQAEAQAEVLKQMSSVYGQQAGQAGQLQEQAMQSFNTALQTLQNIADSQTQTTSAIFN

SEQ ID NO: 811 - protein, 496 aa, Chlamydia pneumoniae
  CPn0809
DTNMSISSSSGPDNQKNIMSQVLTSTPQGVPQQDKLSGNETKQIQQTRQGKNTEMESDATIAGASGKDKTSSTTKTETAPQQGVAAGKESSESQKAGADTGVSGAAATTASNTATKIAMQTSIEEASKSMESTLESLQSLSAAQMKEVEAVVVAALSGKSSGSAKLETPELPKPGVTPRSEVIEIGLALAKAIQTLGEATKSALSNYASTQAQADQTNKLGLEKQAIKIDKEREEYQEMKAAEQKSKDLEGTMDTVNTVMIAVSVAITVISIVAAIFTCGAGLAGLAAGAAVGAAAAGGAAGAAAATTVATQITVQAVVQAVKQAVITAVRQAITAAIKAAVKSGIKAFIKTLVKAIAKAISKGISKVFAKGTQMIAKNFPKLSKVISSLTSKWVTVGVGVVVAAPALGKGIMQMQLSEMQQNVAQFQKEVGKLQAAADMISMFTQFWQQASKIASKQTGESNEMTQKATKLGAQILKAYAAISGAIAGAHKTNNF

SEQ ID NO: 812 - protein, 123 aa, Chlamydia pneumoniae
  CPn0810
GEIMNKKPKKTKKAVQSKAAPVKRVPEESQEAAIQQLELAVSDLYKELPLAQTFASLTDKNQINSIIAALSGTLESLHLEELTQGLFPSAQEDANFAKELSSVVHGLKNLTTVVNKQMVKGAE

SEQ ID NO: 813 - protein, 242 aa, Chlamydia pneumoniae
  CPn0811
IQNNFILGIRSMSKPSPRNANQPQKPSASFNKKTRSRLAELAAQKKAKADDLEQVHPVPTEEEIKKALGNIFEGLSNGLDLQQILGLSDYLLEEIYTVAYTFYSQGKYNEAVGLFQLLAAAQPQNYKYMLGLSSCYHQLHLYNEAAFGFFLAFDAQPDNPIPPYYIADSLLKLQQPEESNNFLDVTMDICGNNPEFKILKERCQIMKQSIEKQMAGETKKAPTKKPAGKSKTTTNKKSGKKR

SEQ ID NO: 814 - protein, 594 aa, Chlamydia pneumoniae
  CPn0812
GILICWLGNLTKAPMSTRRPIQLLDPLTINQIAAGEVIENSVSVVKELIENSLDAGADEIEIETLGGGQGAIIIRDNGCGFRAEDIPIALQRHATSKIREFSDIFSLNSFGFRGEALPSIASISKMEIQSSIEGDEGVRTVIHGGDIVSCEPCARQLGTTVIVNSLFYNVPVRRGFQKSMQSDRLGIRKLIENRILSTANIGWSWISEGHHEIQIAKQQGFQERVAYVMGDHFMQDALTIDKEANGVRIVGVLGSPSFHRPTRQGQKIFINDRPIESLFISKKVGDAYALLLPLHRYPVFVLKLYLPSSWCDFNVHPQKIEARILKEELVGDCIKEAIVETLACPPGILCRTHQEIEESDSVPLPMFRMLETSDVQEEESVEFDQNLFAYSSEDVSLEKQEYTSRGPKSQMDWIYSSDVRFLTSLGRVVLAEDLEGVHIIFTAAARKHLFFLSLMQENSRMYQSQALLIPLRLQVTPEEAFFFSHHGRTLCDLGIEISQVGPCVFSIESTPTVIGEEELKEWLLLLAARGSTDINSEALTALMKETLTQATFSKHQHVFDVSWLKLLWSVGKPEKGFDGARIRRLILDSDFMEG

SEQ ID NO: 815 - protein, 364 aa, Chlamydia pneumoniae
  CPn0813
TLILWKDNHMSHDRILRAQRALSEHNLDAILVEKSEDLAYFLHDEAIAGILLIGQQEVMFFVYRMDKDLYSHIQRVPLTFLTQDVVADLSLYVQKQRYQKIGFDSASTVYHKFAQRQVLPCLWEPLECFTEKIRSIKSEEEIRRMQEAAALGSAGYDYVLTLLREGITEKEVVRQLRAFWAEAGAEGPSFPPIIAFGEHSAFPHSIPTDRPLKKGDIVLIDIGVLLNGYCSDMTRMTALGTPHPKLLESYPVVVEAQKRAMALCKEGVLWGDIDAEAVRVLREHHLDTYFIHGIGHGVGRHIHEYPCSPRGSQVKLESGMTITVEPGVYFPGIGGIRIEDTLCIDKNKNFSLTARPVISELVCL

SEQ ID NO: 816 - protein, 454 aa, Chlamydia pneumoniae
  CPn0814
FFLFFKLSYNFIFNLPLTMYQLLSIGYSFVSFIALLWMLCYSPNYVTDLYRISLSAEESLGGIRAFPQAESLLGGACALNFPDLEERLPDLRKELLFLGSNDRPDACGGKFSLQLASSKECYIAALKERVYLNVTNSSRGPVYSFSPKGVPTELWIECFSVSVDGRVEVKVRLQGLHKELISKPRDCETLFLNPPANKLDCWEIAGFRVDASFPVKQKIRRIGVDKFLLMHGGAEYADKATKERVDFVSSDEENYSRYLAVGDVLLWDGNCWQTCGEFQGASSRAPLFEVKRIDDKVMIADLWNVGGTQRQTISLVKGVPSPIEINEVIREIEFTGMRSWSKPIVLVGGQRLILSPDDWVLRTAKGWEKLSRADQIQDYVTGKVTGPLLVFEKLEKDLRGFVLRGHMFNAQRTLVETISLPLKQGFEPAVASQEVSSNTRSAAAHPGATNRGGS

SEQ ID NO: 817 - protein, 754 aa, Chlamydia pneumoniae
  CPn0815
MVFFRNSLLHLVALSGMLCCSSGVALTIAEKMASLEHSGRGADDYEGMASFNANMREYSLQLSKLYEEARKLRASGTEDEALWKDLIRRIGEVRGYLREIEELWAAEIREKGGNLEDYALWNHPETTIYNLVTDYGTEDSIYLIPQEIGAIKIATLSKFVVPKESFEDCLTQILSRLGIGVRQVNSWIKELYMMRKEGCSVAGVFSSRKDLEALPETAYIGFVLNSNVDAHTNQHVLKKFINPETTHVDVIAGRVWIFGSAGEVGELLKIYNFVQSESIRQEYRVIPLTKIDPGEMISILNAAFREDLTKDVSEESLGLRVVPLQYQGRSLFLSGTAALVQQALTLIRELEEGIENPTDKTVFWYNVKHSDPQELAALLSQVHDVFSGENKASVGAADGCGSQLNASIQIDTTVSSSAKDGSVKYGNFIADSKTGTLIMVVEKEVLPRIQMLLKKLDVPKKMVRIEVLLFERKLAHEQKSGLNLLRLGEEVCKKGCSPSVSWAGGTGILEFLFKGSTGSSIVPGYDLAYQFLMAQEDVRINASPSVVTMNQTPARIAVVDEMSIAVSSDKDKAQYNRAQYGIMIKMLPVINVGEEDGKSYITLETDITFDTTGKNHDDRPDVTRRNITNKVRIADGETVIIGGLRCKQMSDSHDGIPFLGDIPGIGKLFGMSSTSDSLTEMFVFITPKILENPVEQQERKEEALLSSRPGEREEYYQALAASEAAARAAHKKLEMFPASGVSLSQVERQEYDGC

SEQ ID NO: 818 - protein, 501 aa, Chlamydia pneumoniae
  CPn0816
RGKNTMAASILSQELLDILPYTFLKKHCLLPIEESSEAITIAHATATSVIAQDEVKLLIKKPVRFVLKEESEILQRLQQLYSNREGNVSDMLLTMKEEDGTTISEEEDLLETTDTIPVVRLLNWILKEAIEERASDIHFEPCEDSMRIRYRIDGVLHDRHSPPSHLRSALTTRLKVLAKMDIAEHRLPQDGRIKIHIGGQEVDMRVSTVPVIYGERVVLRILDKRNVILDIAGLHMPKGTEILFKDTITAPEGILLVTGPTGSGKTTTLYSVLQELKGPLTNIMTIEDPPEYKLPGIAQIAVKPKIGLTFARGLRHLLRQDPDILMVGEIRDQETAEIAIQAALTGHLVVSTLHTNDAISAIPRLLDMGIESYLLSATLVGVVAQRLVRTICPYCKVAYTPENQEKSFLASLGKDTEMPLYRGQGCVHCFRSGYKGRQGIYEFLRPNTLFRSEVASNRPYHILRETAEQNGFLPILEHGIALAVSGETTLAEVLRVTKRCD

SEQ ID NO: 819 - protein, 394 aa, Chlamydia pneumoniae
  CPn0817
GGRMPRYRYTYLDPKERRKRGYLEALHIQEAREKLAQENIQVLDIREVALRRMSIKSTELIVFTKQLLLLLRSGLPLYESLVSLRDQYHEQKMGLLLTSFMETLRSGGSLSQAMAAHPNIFDHFYCSGVAAGESVGNLEGCLQNIIVVLEERAQITKKMVGALSYPCVLLVFSFAVMLFFLLGVIPSLKETFENMEVKGLTKIVFGVSDCLSAYRYLFLGFASALITVGILMRHRIPWKKILEKLLFALPGTKKFVVKVAVNRFCSVASAILKGGGTLIEGLDLGCDAIPYDRLKTDMRDIVQAVIGGGSLSQELAQRSWVPKLAIGMIALGEESGDLADVLGYVAHIYNEDTQKTLASITSWCQPVILIFLGGLIGVIMLAILIPLTSNIQTL

SEQ ID NO: 820 - protein, 175 aa, Chlamydia pneumoniae
  CPn0818
GYTKNVGFDNVVVSTRDSDFSWWPDRCDHVGNIDPTHKQYPNIIKCVLRGVGMKRQKRKQSITLIEMMVVITLIGIIGGALAFNMRGSIHKGKVFQSEQNCAKVYDILMMEYATGGSSLKEIIAHKETVVEEASWCKEGRKLLKDAWGEDLIVQLNDKGDDLVIFSKRVQSSNKK

SEQ ID NO: 821 - protein, 54 aa, Chlamydia pneumoniae
  CPn0819
ASLYGYCLFLIWEKFHNNIGKANFHLKIITTDFLTDIYIVTIRDPIAYPLTGIC

SEQ ID NO: 822 - protein, 206 aa, Chlamydia pneumoniae
  CPn0820
DESLPCRCCCGTFPRSETSSIRTEMPMCNSIAMKKQKRGFVLMELLMSFTLIALLLGTLGFWYRKIYTVQKQKERIYNFYIEESRAYKQLRTLFSMSLSSSYEEPGSLFSLIFDRGVYRDPKLAGAVRASLHHDTKDQRLELRICNIKDQSYFETQRLLSHVTHVVLSFQRNPDPEKLPETIALTITREPKAYPPRTLTYQFAVGK

SEQ ID NO: 823 - protein, 344 aa, Chlamydia pneumoniae
  CPn0821
HTNLRLGNKPMQPFIFTLLCLTSLVSLVAFDAANARKRCACAQTIERGENFFSIKRSACAEIEYQEKSRHASAIERISKDKGKVTPKQIAKVATKKKQRYRLLQVPFSRPPNNSRYNLYALLSEPPECYSDTASWYAIFIRLLRRAYVDTGNVPPGSEYAIANALISNKQEILERGAQLGPDVIETLTLPEEQAEIFYKMLKGSSNSQSLLNFLHYEEKSLGHCKLNLIFMDPLLLEAVLDHPDAYRETSLLRDGIWEAVKRQEHAIQEHGQAAALELFKTRTDFRLELRDKMQLLLSRYDLLPLLNKKMFDYTLGSAGDYLFLVDPDTKAISRCRCPSKSIKL

SEQ ID NO: 824 - protein, 177 aa, Chlamydia pneumoniae
  CPn0822
FFLIIVLISTIKNISIGRTMADETPKENSSKESSSQFDSLKRKVKDLHSNPKVGKWKKFLSHRACEAIGGCLVLVGIIADFISWAGGLFIACGVVLGFHVEIRKMLSNLQSYSIANGPIKNAILCGLILFFVLNIPSFAVSFIVLCVILSFITTAPSCSTCSKDHCDKHQDTSNKPS

SEQ ID NO: 825 - protein, 308 aa, Chlamydia pneumoniae
  CPn0823
FYALQVRFSKTSINGNKELMGISLPELFSNLGSAYLDYIFQHPPAYVWSVFLLLLARLLPIFAVAPFLGAKLFPSPIKIGISLSWLAIIFPKVLADTQITNYMDNNLFYVLLVKEMIIGIVIGFVLAFPFYAAQSAGSFITNQQGIQGLEGATSLISIEQTSPHGILYHYFVTIIFWLVGGHRIVISLLLQTLEVIPIHSFFPAEMMSLSAPIWITMIKMCQLCLVMTIQLSAPAALAMLMSDLFLGIINRMAPQVQVIYLLSALKAFMGLLFLTLAWWFIIKQIDYFTLAWFKEVPIMLLGSNPQVL

SEQ ID NO: 826 - protein, 100 aa, Chlamydia pneumoniae
  CPn0824
IRTRAVLAFFATSFKSVLFEYSYQSLLLILIVSAPPIILASIVGIMVAIFQAATQIQEQTFAFAVKLVVIFGTLMISGGWLSNMILRFAGQIFQNFYKWK

SEQ ID NO: 827 - protein, 314 aa, Chlamydia pneumoniae
  CPn0825
ERIKVFTIMRSIFRFSLCFFTLSVSCCFADASLYENSCPSRCQPTPPPSNSNPLNVVQQPVAASSVPSYMPPLNADDVLPRDHLSDGSFSDTYPDITTQAIILIFLALSPFLVMLLTSYLKIIITLVLLRNALGVQQTPPSQVLNGIALILSIYVMFPTGVAMYKDARKEIEANTIPQSLFTAEGAETVFVALNKSKEPLRSFLIRNTPKAQIQSFYKISQKTFPSEIRAHLTASDFVIIIPAFIMGQIKNAFEIGVLIYLPFFVIDLVTANVLVAMQMMMLSPLSISLPLKLLLIVMVDGWTLLLQGLMISFK

SEQ ID NO: 828 - protein, 257 aa, Chlamydia pneumoniae
  CPn0826
HDNKRSGVFSSEVNQPQRYYAIVKMKFFSLIFKDDDVSPNKKVLSPEAFSAFLDAKELLEKTKADSEAYVAETEQKCAQIRQEAKDQGFKEGSESWSKQIAFLEEETKNLRIRVREALVPLAIASVRKIIGKELELHPETIVSIISQALKELTQNKHIIISVNPKDLPLVEKSRPELKNIVEYADSLILTAKPDVTPGGCIIETEAGIINAQLDVQLDALEKAFSTILKAKNPVDEPSETSSSTDSSSLSNDQDKKE

SEQ ID NO: 829 - protein, 280 aa, Chlamydia pneumoniae
  CPn0827
GCLVTANTFGTLDILMKHSKEDDLSRFLPKNLLVESPHPEEIPLKSLSFTMSWLPTIHPSWITIAMKEFPPEIQGQLLAWLPEPLVQEILPLLPGISIAPHRCAPFGAFYLLDMLSKKIRPCGITEEIFLPASSANAILYYTGPVKIALINCLGLYSIAKELKHILDKVVIERVKNALSPTEKLFLTYCQSHPMKHLETTNFLSSWTTDAELRQFVHKQGLEFLGKALTKENASFLWYFLRRLDVGRAYIVEQTLKTWYDHPYVDYFKSRLEQCMKVLVK

SEQ ID NO: 830 - protein, 342 aa, Chlamydia pneumoniae
  CPn0828
IKRYAWIMVRRSISFCLFFLMTLLCCTSCNSRSLIVHGLPGREANEIVVLLVSKGVAAQKLPQAAAATAGAATEQMWDIAVPSAQITEALAILNQAGLPRMKGTSLLDLFAKQGLVPSELQEKIRYQEGLSEQMASTIRKMDGVVDASVQISFTTENEDNLPLTASVYIKHRGVLDNPNSIMVSKIKRLIASAVPGLVPENVSVVSDRAAYSDITINGPWGLTEEIDYVSVWGIILAKSSLTKFRLIFYVLILILFVISCGLLWVIWKTHTLIMTMGGTKGFFNPTPYTKNALEAKKAEGAAADKEKKEDADSQGESKNAETSDKDSSDKDAPEGSNEIEGA

SEQ ID NO: 831 - protein, 190 aa, Chlamydia pneumoniae
  CPn0829
KYICFVPTLAKSFYINIRDSRFYSWLCFIMKETYYRDFLHENYLKNKKSMFMKIYKTAGEFFLANAKWPLVPAGYRRVRGKDFVLSPLVDLVILFPWVTKDSRYSPCSMTFTCICRSIVECIPVVSTLFGIGRFCAVWCVEGFSGSTFDKIYHTIVAVLGILGLGILTFILRIIFSVLMLPVWFLFKCYS

SEQ ID NO: 832 - protein, 207 aa, Chlamydia pneumoniae
  CPn0830
DSCSFLLPCFEVEAQTFPQVFSKVVVYKYKSSRILLIALLYNITLVLGLIFIHKKYLGQKGRVILKIYQNEEEFFRATERFPSIGAGYLRVRNKNSVLFPFEDLMLVCPSVPKDFPLSAFKVTTKLIYWSVLESIPVVGAFFFSIGRLFAMWCIEDFPGSIFSRIYHTIVGVLGILGLGIIMFILRIIFTLLTLPFWLISCLKSSAA

SEQ ID NO: 833 - protein, 62 aa, Chlamydia pneumoniae
  CPn0831
NKRKNNVLIRKSESEGAFFEATQNYPTIQQGYQLVRIREHNLSVRAHFDLSLSLDASVHPAA

SEQ ID NO: 834 - protein, 308 aa, Chlamydia pneumoniae
  CPn0832
VMKCRPTLNTDQPRVRKKLPERFPKWLQRPLPQGSAFHATDATIKRSGMPTVCEEALCPNRAECWSRKTATYLALGDVCTRSCGFCNIGHSKTPPALDPTEPERIALSAKELGLKHVVITMVARDDLEDGGAQGLVDIIQKLREELPQATTEVLASDFQGNVSALHTLLDSGITIYNHNVETVARLSPLVRHKATYARSMFMLEQAANYLPDLKIKSGIMVGLGEMEGEVKQTLQDLASIGVRIVTIGQYLRPSRKHLQVKSYVTPETFDYYRRVGEAMGLFVYAGPFVRSSFNADMILASVQDKASA

SEQ ID NO: 835 - protein, 475 aa, Chlamydia pneumoniae
  CPn0833
RGVLFEILITVSENMTQEFDCVVIGAGPSGYVAAITAAQSKLRTALIEEDQAGGTCLNRGCIPSKALIAGANVVSHIKHAEQFGIHVDGYTIDYPAMAKRKNTVVQGIRQGLEGLIRSNKITVLKGTGSLVSSTEVKVIGQDTTIIKANHIILATGSEPRPFPGVPFSSRILSSTGILELEVLPKKLAIIGGGVIGCEFASLFHTLGVEITVIEALDHILAVNNKEVSQTVTNKFTKQGIRILTKASISAIEESQNQVRITVNDQVEEFDYVLVAIGRQFNTASIGLDNAGVIRDDRGVIPVDETMRTNVPNIYAIGDITGKWLLAHVASHQGVIAAKNISGHHEVMDYSAIPSVIFTHPEIAMVGLSLQEAEQQNLPAKLTKFPFKAIGKAVALGASDGFAAIVSHEITQQILGAYVIGPHASSLIGEMTLAIRNELTLPCIYETVHAHPTLSEVWAEGALLATNHPLHFPPKS

SEQ ID NO: 836 - protein, 157 aa, Chlamydia pneumoniae
  CPn0834
KIPMPFAKETEMQRTCWKCEGSVSMHVPQCPYCSAFLQDPPVASGGFSSCHISFPEGASKEEAEDLFAVSSEDWEAVLGDQNPTQETNKQVIPEWTWLQSWPLAALFLGIGLLAFAFLILLFSTDSGLVLTWPKNRAYFYGIIGAAVAYRGYRKLPL

SEQ ID NO: 837 - protein, 1218 aa, Chlamydia pneumoniae
  CPn0835
HNIMVLEALAIFRQDAMQHLLKHRKEIVVDFCEDSYTIRIPDEEAPEGYWLSTLKLQDIDRLTFASCSCPDGECCLHLMTAYFAVYDALGLHPLHDKFRHSFWYAVFSHFFLDSIPLQAQGEMVYTLESPHITLTIECLSEEVFQDWLRTIHASEEPTVFTNKTFLKSALYRTAKKFFFLNEEGAELTIGENSQGFPSHFSLQWQGLVFKAEILDFPTLEDIFPKLELAHTSLENVSHDISITNVTVCAEEAKVNFTLSPVIHKKDRENHPKTRIGSVEYVAKTHEMITGPKAIALPIYAIPLLADKFKDQLLSLLCYDSLEYRLRYDIRLLRDASFSFSAYLVTPGDLDNGSLIYPNYCYSPTKGLMQVVGMLSPKQAFIVKSEQVEDFLNERGHLIQEPGFQTFINERPEGHLTYNVTEQGVLLFHYDVGDPSSTEIRFGTWTYYTNQGFFLEKKNDLPIQDGLIVEPQDIPAFIVKNDAALRRLPNFFSSPPNLKDLLIEVHRQSRGKGLDLKPILVGLGESRCWLFGVFLYREDIGFSLIPTPLQGLCFLPRVIPPENVPQFLTQYAQHERILFPNPQTRPPESYELVIQSIHRPHPASPLHLQLELKTNLGSVPIGIALQGLKSKHTFLFTQAGFLDLKQNLFQFLKQFLSTQKCVIAENTVIANITDVFKLDALAPLSVTDDTIANPEDLQFFSQLKAACLPPIPQNLFSSDHQLRPYQNSGLLWMWFLYNHRLSGLLCDEMGLGKTHQATALLDIVFQSSQPSARPKFLIVCPTSVLPHWEHILSNHLPGVSIFSFHGPNKPSELPPADILLTSYGTLRQNYDKFYKIAFTIVVFDEIHMAKNKSSQIHKILCRIDAQMKLGLTGTPIENNLLEFKGLLDIILPNYLPSDALFKKLFTKRCSSEELEEIIPSQDLLLKLTRPFILRRTKKLVLPELPDKVESIIACSLSPDQEKLYMATLQREKSHIQKLETPEEPATNFLHIFALLNHLKQICDHPAVFFKDPDQYKNYESGKWNAFVKLLKESLNAGYKVVVFSQYIHMIRIITLYLEEIGIKYASIQGKSLNRKEEIETFTTDPNCQVFVGSLLAAGTGINLTAGNVVIMYDRWWNPAKENQALDRVHRIGQKNTVFIYKLITEDTLEERIHYLIEKKIRLLDKVIASQDSNILHMLNREDLLTILSYKDEHGTSDSEESPVDAPVEDDTGVLPPEDS

SEQ ID NO: 838 - protein, 413 aa, Chlamydia pneumoniae
  CPn0836
KMKKNASHKTNDKKSLSIWSIGGSIFAMFFGAGNIVFPLALGYHYNAHPWSAYFGMMLTAVCVPLLGLVSMLFYSGDYQKFFFSIGRIPGMIFITAIILLIGPFGGIPRAIAVSHATLISLSEHKSAFIPSLPIFSAICCVLIYIFSCKLSRLIQWLGSVFFPIMLVTLLWVIIRSFMIPTHPMVQEFIPNARQAWLAGFIEGFNTMDLLAAFFFCSIVLISLRQLVAEEKHPTEEEIPLSFQGISKKNKRSLALGFFLAAILLGMTYLGFVLSAARHAGLLVNVSKGHILGRISAIALGPNSILAGVSVFIACLTTEIALVGIVADFLARVVSFKKLNYASAVICTLIPTYLISILNFETISHLLLPLLQLSYPALIVLACGNIAYKLWNFRYSPVLFYLTLSLTIVLKLVN

SEQ ID NO: 839 - protein, 211 aa, Chlamydia pneumoniae
  CPn0837
LTMKQFILRTLNALFPNPKPSLEGWSSPFQLLIAILLSGNSTDKAVNSVTPQLFAKAPDAQSILDLPPGKLYQLIAPCGLGERKSAYIYQLSQILVRDFHGEPPNDMALLTQLPGVGRKTASVFLGIAYGKPTFPVDTHILRLAQRWKISEKKSPSAAEKDLARFFGHENTPKLHLQLIYYARQYCPALHHKIDNCPICSYLAKEANSTRT

SEQ ID NO: 840 - protein, 472 aa, Chlamydia pneumoniae
  CPn0838
ISLNIYPNSFHLFNLKLGILSESSFNFSIFMLKHDTIAAIATPPGEGSIAVVRLSGPQAIVIADRIFSGSVASFASHTIHLGQVIFEETLIDQALLLLMRSPRSFTGEDVVEFQCHGGFFACSQILDALIALGARPALPGEFSQRAFLNGKIDLVQAEAIQNLIVAENIDAFRIAQTHFQGNFSKKIQEIHTLIIEALAFLEVLADFPEEEQPDLLVPQEKIQNALHIVEDFISSFDEGQRLAQGTSLILAGKPNVGKSSLLNALLQKNRAIVTHIPGTTRDILEEQWLLQGKRIRLLDTAGQRTTDNDIEKEGIERALSAMEEADGILWVIDATQPLEDLPKILFTKPSFLLWNKADLTPPPFLDTSLPQFAISAKTGEGLTQVKQALIQWMQKQEAGKTSKVFLVSSRHHMILQEVARCLKEAQQNLYLQPPEIIALELREALHSIGMLSGKEVTESILGEIFSKFCIGK

SEQ ID NO: 841 - protein, 310 aa, Chlamydia pneumoniae
  CPn0839
FLFIVSRGLVQKPQYIDRITKKKVIEPIFYEKTMLFLYNSKLGKKLSVFLSTHPIFSRIYGWLQRCSWTRRQIRPFMNRYKISEKELTKPVADFTSFNDFFTRKLKPEARPIVGGKEVFITPVDGRYLVYPNVSEFDKFIVKSKAFSLPKLLGDHELTKLYAHGSIVFARLAPFDYHRFHFPCDCLPQKTRCVNGALFSVHPLAVKDNFILFCENKRTVTVLETEQFGNVLYLEVGAMNVGSIVQTFSPNQTYAKGDEKGFFAFGGSTVILLFLPNAIRFDNDLLKNSRMGFETRCLMGQSLGRSQREEI

SEQ ID NO: 842 - protein, 468 aa, Chlamydia pneumoniae
  CPn0840
ISERRNLKTLKTFFGIAKRDKSQKWRIMWLVILWALAASLAIALVAKGYYRFVYFRRYAVQVIREVRLSMELKEWALAEQQLLPILKKRSYRRQCLFEYMRILRKMQRFEESEKLLAEAKKLGLRGPYFFLEIAYKAYRFGAFKECAQAFASVPQDLFEEEDAAKYASALVRLGDLDAACSLIEPWISPLSHQETFVTMGHIYFTSKRYKDAIDFYNRANALGVCPVEVTYNLAQAYRITSSYAKAGKLFRKLLSNPVYKEEALFNIGLCEQKLGRPGKALLIYQSSDLWSRGDALLMKYAAMAAMDQRDYVLAEPCWELALRCSTFAKDYKCGLGYGFSLCRLRKYGDAERVYCNLIQNFPECLTACKALAWLCGVGYATLLGSEEGLMYAKKAVELDHSCETLELLSACEARCGNFDAAYEIQSFLSSRDTSLQEKQRRSQILRILRKKLPLNDHHIVEVDALLAA

SEQ ID NO: 843 - protein, 974 aa, Chlamydia pneumoniae
  CPn0841
IKRHMLGFLKRFFGSSQERILKKFQKLVDKVNIYDEMLTPLSDDELRNKTAELKQRYQNGESLDSMLPEAYGVVKNVCRRLAGTPVEVSGYHQRWDMVPYDVQILGAIAMHKGFITEMQTGEGKTLTAVMPLYLNALTGKPVHLVTVNDYLAQRDCEWVGSVLRWLGLTTGVLVSGTLLEKRKKIYQCDVVYGTASEFGFDYLRDNSIATRLEEQVGRGYYFAIIDEVDSILIDEARTPLIISGPGEKHNPVYFELKEKVASLVYLQKELCSRIALEARRGLDSFLDVDILPKDKKVLEGISEFCRSLWLVSKGMPLNRVLRRVREHPDLRAMIDKWDVYYHAEQNKEESLERLSELYIIVDEHNNDFELTDKGMQQWVEYAGGSTEEFVMMDMGHEYALIENDETLSPADKINKKIAISEEDTLRKARAHGLRQLLRAQLLMERDVDYIVRDDQIVIIDEHTGRPQPGRRFSEGLHQAIEAKEHVTIRKESQTLATVTLQNFFRLYEKLAGMTGTAITESREFKEIYNLYVLQVPTFKPCLRIDHNDEFYMTEREKYHAIVNEIATIHGKGNPILVGTESVEVSEKLSRILRQNRIEHTVLNAKNHAQEAEIIAGAGKLGAVTVATNMAGRGTDIKLDNEAVIVGGLHVIGTTRHQSRRIDRQLRGRCARLGDPGAAKFFLSFEDRLMRLFASPKLNTLIRHFRPPEGEAMSDPMFNRLIETAQKRVEGRNYTIRKHTLEYDDVMNKQRQAIYAFRHDVLHAESVFDLAKEILCHVSLMVASLVMSDRQFKGWTLPNLEEWITSSFPIALNIEELRQLKDTDSIAEKIAAELIQEFQVRFDHMVEGLSKAGGEELDASAICRDVVRSVMVMHIDEQWRIHLVDMDLLRSEVGLRTVGQKDPLLEFKHESFLLFESLIRDIRITIARHLFRLELTVEPNPRVNNVIPTVATSFHNNVNYGPLELTVVTDSEDQD

SEQ ID NO: 844 - protein, 103 aa, Chlamydia pneumoniae
  CPn0842
KYYTPPTISRSPWSNIALKTISESEYDCNQQLLKTQSLLTTNVDTLLNAPKDFPNSKNQKHILFCIANNTLSHYAQFLIAGNRRKFWIRYYNDQVWSEWTPFI

SEQ ID NO: 845 - protein, 79 aa, Chlamydia pneumoniae
  CPn0843
NKNKLIISWRFKVMNYDQYDTPDTDHDQIFEDLLDNSEEAASLDKYQETGVYVEENTDQGDLLIVLGESVFKNTIHQEQ

SEQ ID NO: 846 - protein, 494 aa, Chlamydia pneumoniae
  CPn0844
KNRIETIMLKIAILGRPNVGKSSLFNRLCKRSLAIVNSQEGTTRDRLYGELHAFGVPAQVIDTGGVDHNSEDYFQKHIYNQALTGAKEADVLLLVIDIRCGITEEDAHLAKLLLPLKKPLILVANKADSRQEELQIHETYKLGIRDIVVTSTAHDKHIDTLLQRIKLVANLPEPREEEEEGLEELSVDEHEESEAALPSNTFPDFSEVFTEGFSPEEPCTIPESPQQAPKTLKIALIGRPNVGKSSIINGLLNEERCIIDNTPGTTRDNIDILYSHKDRQYLFIDTAGLRKMKSVKNSIEWISSSRTEKAISRADICLLVIDATQKLSSYEKRILSLISKRKKPHIILINKWDLLEEVRMEHYCKDLRATDPYLGQAKMLCISATTKRNLKKIFSAIDELHHVVSNKVPTPIVNKTLASALHRNHPQVIQGRRLRIYYAIQKTTTPLQFLLFINAKSLLTKHYEYYLKNTLKSSFNLYGIPFDLEFKEKPKRHN

SEQ ID NO: 847 - protein, 434 aa, Chlamydia pneumoniae
  CPn0845
SANNYQKDPRSYRLALFSSYFRGVMTTIAIEAAKKVLIKLRNAGYQAYFVGGCVRDMLMNRPLEDIDIATNASPTIVSTIFPDVISIGVAFGIIVVKQDGRLFEVATFRSDGEYKDGRHPDRIIFSSMREDALRRDFTVNGMYYDPFEDKVFDFVEGTRDIEKKVIRAIGHPRLRFSEDKLRILRAIRFSSSLGFTLDPTTERAIIKEAPALVNSVSPERIWQELKKMLKRQPYGALSLLLKLKVLIFIFPELRDIPYSLLRTTIEFARKFNPTHFPEILFLLPLFQGVSEEAATVAFGRLRISNKELKLIESWYEALPHFQNQSGNRVFWAHFLASPTAPLFLELFSALQKDPSRQQHFISRVQELESRLEQFILRIKTSSPVVSAPDLIAKGISPGRLLGDLLREAEILSIENECLDKEKILLLLQEKGFWK

SEQ ID NO: 848 - protein, 424 aa, Chlamydia pneumoniae
  CPn0846
REHMNKKNLTICSFCGRSEKDVEKLIAGPSVYICDYCIKLCSGILDKKPSSTISSAPVSETPSQPSDLRVLTPKEIKKHIDEYVIGQERAKKTIAVAVYNHYKRIRALLHNKQVSYGKSNVLLLGPTGSGKTLIAKTLAKILDVPFTIADATTLTEAGYVGEDVENIVLRLLQAADYDVARAERGIIYIDEIDKIGRTTANVSITRDVSGEGVQQALLKIVEGTTANVPPKGGRKHPNQEYIRVNTENILFIVGGAFVNLDKIIAKRLGKTTIGFSDDQADLSQKTRDHLLAKVETEDLIAFGMIPEFVGRFNCIVNCEELSLDELVAILTEPTNAIVKQYMELFAEENVKLVFKKEALYAIAKKAKQAKTGARALGMILENLLRDLMFEIPSDPTVEAIHIQEDTIAENKAPIIIRRTPEAIA

SEQ ID NO: 849 - protein, 211 aa, Chlamydia pneumoniae
  CPn0847
KLFDEETQMTLVPYVVEDTGRGERAMDIYSRLLKDRIVMIGQEITEPLANTVIAQLLFLMSEDPKKDIQIFINSPGGYITAGLAIYDTIRFLGCDVNTYCIGQAASMGALLLSAGTKGKRHALPHSRMMIHQPSGGIIGTSADIQLQAAEILTLKKHLANILSECTGQPVEKIIEDSERDFFMGAEEAISYGLIDKVVTSAKETNKDTSST

SEQ ID NO: 850 - protein, 460 aa, Chlamydia pneumoniae
  CPn0848
VQASSPAFPFKSNKKGCLVPRSLSNEQFSVDLEESPGCIVSALVKVSPEVLNKLNKQALKKIKKEITLPGFRKGKAPDDVIASRYPTNVRKELGELVTQDAYHALSTVGDRRPLSPKAVRSNSITQFDLQEGAKVEFSYEAFPAISDLPWENLSLPQEEAASEISDSDIEKGLTNIGMFFATKTPVERPSQEGDFISISLHVSKSNDENASSAAIFENKYFKLSEEEMTDAFKEKFLGISTGHRVVETITSPEIQSFLRGDTLTFTVNAVIEVSIPEIDDEKARQLQAESLDDLKAKLRIQLEKQAKDKQLQKRFSEAEDALAMLVDFELPTSLLEERISLITREKLLNARLIQYCSDEELEKRKSELIKEAEEDATKALKLLFLTHKIFSDEKLTISREELQYMMDVCSRERFGQQPPKDISNDTLQELVMSARDRLTYSKAIEHVLRKAELLASTPSA

SEQ ID NO: 851 - protein, 1178 aa, Chlamydia pneumoniae
  CPn0849
ADYIIHSYSRGEMLNFRKLRRDFSANILQDGKKLFEQGAVIDAKILSMNGETVCISAQVRGLYDNIYECEIEVDRSESDTVDSNCDCSYNYDCQHIVALLFYLEQYFNEMVVAYARSADLETDHEINEEVKKELKETFVAAATKEEERKDREHQKEILREYVHAANALSANPFFLPLEYLEKDSAELAVLFVSVNEDTFAPANQPIEFQLVLRLPCRSKPFYISNIRTFLEGVLYQEPIVLNGRRFFFTMQSFNASDRKLIDLLIRYVRYPNHTTEEKLLKSAYLMPPALGVILAKMFEHQLADRGGGSLGEKESFSGLFCGNLEEPLCWSLTPAKMKFNLDFFDMPYKALLMTPVILVDDDEVQPEQTMLLESDAPGIIHHFVYHRFSPQIKRAHLRSFSRLRDIAIPEALFGSFRENALPVFQEYAEIANVHLLNSFVTLPYVDEVRAICDMSYLDGELEAKLHFLYGSLRVPAASLALQYQDVRAFISDEGILARNLVEERKMLEEVFSGFIYDERDGAFRVKSEKKIVEFMTETIPANQHRITFNCPENLSGQFIYDETIFELSFREGSDINYYEADLKVHGLLKGVPLDLLWDCISAKKRFLELPKAGQQSKGTRRGKVNSGKLPCILVLDLEKIAPVVQIFNEIGFKVLDDLVQKCPLWSLTGISLDQFEALPVNFSMSERLIEIQKQIRGEIEFDFQDVPQQIQATLRSYQTEGVHWLERLRKMHLNGILADDMGLGKTLQAIIAVTQSKLEKGSGCSLIVCPTSLVYNWKEEFRKFNPEFRTLVIDGVPSQRRKQLTALADRDVAITSYNLLQKDVELYKSFRFDYVVLDEAHHIKNRTTRNAKSVKMIQSDHRLILTGTPIENSLEELWSLFDFLMPGLLSSYDRFVGKYIRTGNYMGNKADNMVALKKKVSPFILRRMKEDVLKDLPPVSEILYHCHLTESQKELYQSYAASAKQELSRLVKQEGFERIHIHVLATLTRLKQICCHPAIFAKDAPEPGDSAKYDMLMDLLSSLVDSGHKTVVFSQYTKMLGIIKKDLESRGIPFVYLDGSTKNRLDLVNQFNEDPSLLVFLISLKAGGTGLNLVGADTVIHYDMWWNPAVENQATDRVHRIGQSRSVSSYKLVTLNTIEEKILTLQNRKKSLVKKVINSDDEVVSKLTWEEVLELLQI

SEQ ID NO: 852 - protein, 379 aa, Chlamydia pneumoniae
  CPn0850
LGKKYWNCCRYDFMSPHRNLFKLKNFSNRLYNRALGRFDKVFNFFSGNVGIDLGTANTLVYVRGRGIVLSEPSVVAVDAQTHAVLAVGHKAKAMLGKTPRKIMAVRPMKDGVIADFEIAEGMLKALIKRVTPSRSVFRPRILIAVPSGITGVEKRAVEDSALHAGAQEVILIEEPMAAAIGVDLPVHEPAASMIIDIGGGTTEIAIISLGGIVESRSLRIAGDEFDECIINYMRRTYNLMIGPRTAEEIKITIGSAYPLGDQELEMEVRGRDQVAGLPITKRINSVEIRECLAEPIQQIIECVRLTLEKCPPELSADLVERGMVLAGGGALIKGLDKALSKNTGLSVITAPHPLLAVCLGTGKALEHLDQFKKRKGNLV

SEQ ID NO: 853 - protein, 606 aa, Chlamydia pneumoniae
  CPn0851
REFGIVMVWSTNIKHEGLKSWIDEVAKLTTPKDIRLCDGSDTEYDELCTLMESTGTMIRLNPEFHPNCFLVRSSADDVARVEQFTFICTSTEAEAGPTNNWRDPQEMRRELHQLFRGCMQGRTLYIVPFCMGPLDSPFSIVGVELTDSPYVVCSMKIMTRMGDDVLRSLGTSGKFLKCLHSVGKPLSPGEADVSWPCNPKSMRIVHFQDDSSVMSFGSGYGGNALLGKKCVALRLASYMAKSQGWLAEHMLIIGITNPEGKKKYFSASFPSACGKTNLAMLMPKLPGWKIECIGDDIAWIRPGRDGRLYAVNPEYGFFGVAPGTSERTNPNALATCRSNSIFTNVALTADGDVWWEGLTEQPPEPLTDWLGKPWKPGGSPAAHPNSRFTAPLRQCPSLDPEWNSPQGVPLDAIIFGGRRSETIPLVYEALSWEHGVTIGAGMSSTTTAAIVGQLGKLRHDPFAMLPFCGYNMAYYFQHWLSFAENRSLKLPKIFGVNWFRKNNQGEFLWPGFSENLRVLEWIFQRTDGLEDIAERTPIGYLPNIQKFNLNGLNLDLQTVQELFSVDAEGWLAEVENIGEYLKIFGSDCPQQITDELLRIKSELKEK

SEQ ID NO: 854 - protein, 780 aa, Chlamydia pneumoniae
  CPn0852
IKLRIIDYYYLINTVTLQPSYINFTPNVTTALSGGKIDTSAIELSCSALFFQELQDKAQGLKHALGLVQELSAEALRPAQVQTSISYLPTEESSRPGISAGIIDRTMPTFTDDEVKAILQNPNFETSKIFVEGLDKVFKSYLDSVTPPEGIDPSNPESAIILNYITLLNNLKPKFAAGSTPTDADYNALYALPGDFVKEIEALKAADAPPKSKVHAFWQEIMTIYNNMQVLSYPVTDYLNVQIADLSLNITAAQEVQQYLKNFYSILKDILNPGWTDPQATHYPADAEYNARDAGVIQSLLNLSGNYRQLTENMLPNTDTSLPQEIIAQIRSFQNGVNGTIIASNTLLPTTMRLDTLLGVIYTYQCCATIFGMSYGTSTPAKQNYIDAINQEKSYWQARANGFDVTSDQVFDQFATNIQSGTSYRGIDLFKNNKVNEINPIFLSQAASFLRYPYNLMSRSMYQTIEDAANRSITALDGLISGWSTQIATFQTQKNSLDPSLLKYFDTMKANKESFVTTAPLQMVYSSLMLDKYLPTQQNVIASLGIQMTYSNKAAKYLNELIKEITTFQSADIYYSLSIYLKQMNLQAVADPIGKAVGVLNDEKTRAMADITRCNKIKAAIDKMLVEIKADAELSKSQIRELVDTLTNFKSQSDDLIRNLSCLLGFLSGLTLKAVNDPNATYEAFTAEIFTEPFNNWKRQLATFESFVIQGGQNGITPGGQQQLLQAMESSQQDFSTFNQNQQLALQLESSAMQQEWTLVSAALALLNQMVSKIARRIKS

SEQ ID NO: 855 - protein, 391 aa, Chlamydia pneumoniae
  CPn0853
NIMHPKIEKRNSLPLTAVAPVFEESYHPSVATTVDYVDATTLSRHLTVLKDVIKEARNLDLGKAFLTSMKQGFINTGTELAIIQASLADQSSRESRKKEEKIFHQHLGKAAPQAATATSGVQPTADPVADKMPLQSAFAYVLLDKYIPAQEEALYALGRELNLSGYAQNLFSPLLDMIKSFNSAPINYNLGSYISQTSGTANFAYGYEMILSRYNNEVSQCRLDIASTVKAKAALANMSASVKANVSLTDAQKKQIEDIIASYTKSLDVIHTQLTDVMTNLASITFVPGLNKYDPSYRIVGGDLSIIALQNDEKVLVDGKVDITTAVNEGGLLNFFTTVLTDVQNYGDLAQTQQLMLDLELKAMQQQWSLVSASLKLLNGMYTTVISGFKN

SEQ ID NO: 856 - protein, 348 aa, Chlamydia pneumoniae
  CPn0854
GPFDMNSKMLKHLRLATLSFSMFFGIVSSPAVYALGAGNPAAPVLPGVNPEQTGWCAFQLCNSYDLFAALAGSLKFGFYGDYVFSESAHITNVPVITSVTTSGTGTTPTITSTTKNVDFDLNNSSISSSCVFATIALQETSPAAIPLLDIAFTARVGGLKQYYRLPLNAYRDFTSNPLNAESEVTDGLIEVQSDYGIVWGLSLQKVLWKDGVSFVGVSADYRHGSSPINYIIVYNKANPEIYFDATDGNLSYKEWSASIGISTYLNDYVLPYASVSIGNTSRKAPSDSFTELEKQFTNFKFKIRKITNFDRVNFCFGTTCCISNNFYYSVEGRWGYQRAINITSGLQF

SEQ ID NO: 857 - protein, 336 aa, Chlamydia pneumoniae
  CPn0855
GLMKQHIGYLGMGIWGFCLASLLANKGYPVVAWSRNPDLIKQLQEERRHPLAPNVVISPNLSFTTDMKEAIHNAFMIVEGVTSAGIRPVAEQLKQITDLSVPFVITSKGIEQNTGLLLSEIMLEVLGDSVTPYLGYLSGPSIAKEVLNGSPCSVVVSAYDSQTLKQIHEAFSLPTFRVYPNTDIKGAALGGALKNVIAIACGIAEGLSFGNNAKAGLVTRGLHEMRKLAAIMDCKPETLNGLAGLGDLCVTCFSESSRNLRFGHLLAQGLTFEQAKAKIGMVVEGAYTALSAYQVAKHHKIDMPITTGIYRVLYENLDLKEGIALLLQRNTKEEFL

SEQ ID NO: 858 - protein, 472 aa, Chlamydia pneumoniae
  CPn0856
GSRDRNVRLTVMTESVYSPSAMHVNSLADKLKAINQEHILDIWPSLSPKQQQRLFQQLTSVDIDFFRKQQQLLSSPTAILKDFHPITSFASSGEDPERAHAGTTLLKEKKVACVVLAGGQGSRLKCDGPKGLFPVSPIKKKPLFQLVAEKVRAASKLAGQPLPLAFMTSPLNTRQTRSFFESNDYFHLDPNQVDFFCQPLWPLLTLSGDLFLEDMDTLALGPNGNGCIATLLYTSGVWEKWKNAGIEMVSVIPIDNPLALPFDVELCGFHAMSNNEVTIKAALRQTAIEDVGILVKSHDSGKTSVIEYSEIPQNERFALNEDGKLKYCLANIGLYCLSMDFIRHAAYQQLPLYKVHKHAKQLGHTSLNEKNAWKFEEFIFDLFCYSDHCQTLVYPRQECFAPLKNLEGNHSPDTVRQALSDRERQLFHKVTGKKLSPNTTFELEADFYYPSTSTSLHWENKAFFEEPFFEAS

SEQ ID NO: 859 - protein, 139 aa, Chlamydia pneumoniae
  CPn0857
LLLLRQYIKTARGISRLMRDRLGSLSLILKVKIHKYLDTLHNQKRLALTVSRNIQATNKRIADLHLERYEHFISRDNIKHYDILLEYLKTLQSSLYKQQSESLRFLEIHHQQLQELINRRKIIEKIKNNKYSKDQEIGT

SEQ ID NO: 860 - protein, 453 aa, Chlamydia pneumoniae
  CPn0858
RNSETRNQRRTRPSTFCFDSMNHLNKEKLHIHNWQPYRACGLLSKVSGNLIEVDGLSACLGELCKISSTKDPNLLAEVIGFHNHTTLLMSLSPLHSVALGTEVLPLRRPPSLHLSDHLLGRVLDAFGNPIDKKEDLPKTHRKPLLSLPPSPMMRQPIDQIFPTGIKAIDAFLTLGKGQRIGVFSEPGSGKSSLLSAIALGSKSTINVIALIGERGREVREYIEKHSNALKQQRTIIIAAPAHETAPTKVIAGRAAMTIAEYFREQGHEVLFIMDSLSRWIAALQEVALARGETLSAHQYAASVFHHVSEFTERAGNNDKGSITALYAILYYPKHPDIFTDYLKSLLDGHFFLTSQGKALASPPIDILSSLSRSAQALALPHHYAAAERLRSLLKVYNEALDIIHLGAYTPGQDEELDKAVKLLPSIKAFLAQPLSSYCYLDNTLKQLEALADS

SEQ ID NO: 861 - protein, 181 aa, Chlamydia pneumoniae
  CPn0859
VFLVTTPQSPGSLSQSHLPHPHDPWDTEPTSLPEDPNDKASQELHSLVHLFRKLSIHLLSEVEKTVQQLKPDLLELALLICEKFLYKKLENPQELALLLSTALQRHTTLRSLTPIKVFLHPEDLKTLTDWISTHELPMIKHAEFFPDTSCRRSGFKIETPNGILRQEISEELDHLLSVLTA

SEQ ID NO: 862 - protein, 344 aa, Chlamydia pneumoniae
  CPn0860
RTLVFFQNLAKKLTALGISPLGCLLIGGVVSCAILFGRSSNPSLAPTQVKTEKTSGNWLKLTQMGNPKLIESLTKKEQLEKDLTSFHPIASAKVAIALSTEDDVMSPLHLSVILTLRKEESLTPSLLFSITDYLCSSLPGLKREHISLSDNLGNLYIPESITVNSLFIHTLENYLGKIFPKEHFALAYHAKAEKPTLQLTLNENYIAHLTKEESEKIVAHTKHYLYQNYDDSYDIVIETLPFARLQNKKSFPAKVLIGSMILVISLMIVALASFYLARHAYERVSPEPRKIKRGINISKLLEIIQKESPEKIALILSYLDPKKAEALLNRLPEDLKHQVLKYKL

SEQ ID NO: 863 - protein, 276 aa, Chlamydia pneumoniae
  CPn0861
ASYPFTWKFLMTLPLEPMIFWSSLSAKVMKKFLTPHCAGTFSEEDAEAKEAHLVTGKQGHRLMGNCVTFYWLVDKKNGVILDAKFQYFGHPYLIPLAEAVCNLVCGKSYSEAYKMTLDDIDKSLRVHAHQPALPEDSISLYHFVIDALDTAVEQCLEIPLEDGSLPLQNSPMNLDFEDANPYSQSDWEALTHEQKLYALRATIAEKIGPYIAMDGGEVTVESLENFIVTIAYSGNCSGCPSSLGSTLNSIGQLLRAYIYPELQVKVDESSLNLSHP

SEQ ID NO: 864 - protein, 401 aa, Chlamydia pneumoniae
  CPn0862
GRGTIFRITDGKTSCISMEKPQNRKAPRIFWLNNQVAIPPSERVKESYALHSDIFSLPPGSALKLAEKTEESIRQLVGLKDSHIFRFVPHFPHVVHIVLAALVENLSMFQGRNHIILPAHDQQLLINSLCRHQGLGTTYDWVTVNHEGRIVEEQLIETLSPRSLLFSLSAAHGLTGVIQPLDPLLSLCKDRRILLHLDISDILGRAPLTPEILNADIITFSSAALGGMGSIGGIFIRKSLERVFSSWFPPHTSASLCFSAVAAMQTACEERISALPLFTFHTSNLCKKLIQELQSVLPSIQLAFSEVQNRLPNIVVAAIPDIPAESLAFHLHQQGIYPSLGYERFQPLAQVLQNCGISPFLCHSALHFSLTERSKDLEFSKLARAMHDAIKHLTPLLGSSS

SEQ ID NO: 865 - protein, 230 aa, Chlamydia pneumoniae
  CPn0863
EHMALLILLRHGQSVWNEKNLFSGWVDIPLSQQGIEEAFSAGRAIQNLPIDCIFTSTLVRSLMTALLAMTNHHSKKIPYIVHEDPKAKEMSRIYSAEEENNMIPLYQSSALNERMYGELQGKNKKQTAEQFGEERVKLWRRSYKTAPPQGESLYDTKQRTLPYFEKNILPQLQNGKNVFVSAHGNSLRSLIMDLEKLSEEEVLSLELPTGKPVVYQWKNHKIEKHPEFFG

SEQ ID NO: 866 - protein, 239 aa, Chlamydia pneumoniae
  CPn0864
YGVNVTKVRLNKFLASAGVASRRKCDEIIFSGSVTVNGRVAEGPFVLVDPEDKVQVGGTSVHLTKKVYFMVHKAIGYLCSSEKKFPGTKLVIDLFAHLPYRVFTVGRLDKETSGLILVTNDGEFANKIIHPSSGITKEYLLKVSRDVSAKDLGKLMEGTFIDGKHVRPVSVTKIRRGTVKIVVSEGKKHEIRLFADAAGFPILELKRIRIGSLVLGGLRYGEYRELTDAELGTYMKLSD

SEQ ID NO: 867 - protein, 177 aa, Chlamydia pneumoniae
  CPn0865
SPMGYVFYVIAGSIFLGISLGAYCQLYYSVKSVLFSWYLLTVYALEKRHALLALSQLVGEEDAQSQKEIDFLSQCDKLSWRAFLKNSYEIIPTFKEMEDLLSERVQGFLESIETIAEHDRAILCIENFWASKNLFDFEIAAYEEAVEKYLKLRQRAPLRLASKLFRFLDVPSIRFSS

SEQ ID NO: 868 - protein, 193 aa, Chlamydia pneumoniae
  CPn0866
NMKVIYYEIEEIPSTNTMAKSYMHLWDPYALTVISTKCQTAGTGKFGKSWKSSKGDLLNTFCFFITDLHIDVSRLFRLGTEAVVALCKDLGITEAKIKWPNDVLVHGEKLCGVLPETLPVEGLLGVVLGIGLNGNTTKQALKDVGQPATSLQEILGHPIDLETTRELLIHHLLGVLQENLPDSLATKSNRGNI

SEQ ID NO: 869 - protein, 421 aa, Chlamydia pneumoniae
  CPn0867
CIRIPQMHIGFCHCVRGGNFFYFVINNFHILEIYSLLNSNTIMRYHKYFRYVNSWVFLVVLTLMLLSVVVISSMDPTAMLVTSSKGLLTNKSIMQLRHFALGWVVFFICAYFDYHLFKRWAWVLYFFMICALVGLFFVPSVQNVHRWYRIPFIHMSVQPSEYGKLVIVIMLSYILESRKADITSKTTAFLACLVVALPFFLILKEPDLGTALVLCPVTLTIFYLSNVHSLLVKFCTVVATIGIIGSLLIFSGIVSHQKVKPYALKVIKEYQYERLSPSNHHQRASLISIGLGGIRGRGWKTGEFAGRGWLPYGYTDSVFSALGEEFGLLGLLFTLGLFYCLICFGCRTVAVATDDFGKLLAAGITVYLAMHVLINISMMCGLLPITGVPLILISYGGSSVISTMASLGVLQSIYSHRFAKY

SEQ ID NO: 870 - protein, 688 aa, Chlamydia pneumoniae
  CPn0868
NFRNGLGVRDLHHFREYYLIINEIIITGRYVFSRLFFTSFSAEVVNTFFESGMSEDTSPLLSKQNRKLSHNLPLKSAYLSLGTYLIALLSFWLHAKNLSNLFVVFTFFLAGTPALIKSLDNICQKVVNIDILMTSAAFGSIFIGGALEGALLLVLFAISEALGQMVSGKAKSTLVSLKQLAPTTGWLVLEDGNLQKVAINKIEVGNILRIKSGEVVPLDGEILHGSSSINLMHLTGEKVPKSCHPGSIVPAGAHNMEGSFDLRVLRTGSDSTIAHIINLVIQAQNSKPRLQQRLDKYSSVYALSIFAIACGIALLVPLFTSIPLLGPQSAFYRALAFLIAASPCALIIAIPIAYLSAINACAKHGVLLKGGVILDRLVSCNSVVMDKTGTLTTGELTCIGCDYFGSKNETFFPSVLALEQSSSHPIAEAIVSYLMEQKVSSLPADRYLTVPGEGVRGYFNEQEAFVGRVETGLGKVPSEYLEDIEQKIYQAKQHGEICSLAYVGNSFALFYFRDIPRPQAKEIIQDLKDLGYPVSMLTGDHKVSAENTAEILGISEVFFDLTPEDKLAKIRELATQRQIMMVGDGINDAPALAQATVGIAMGEAGSATAIEAADIVLLHDSLSSLPWIIQKAKQTKKVVSQNLALALAIILLVSWPASLGIIPLWLAVILHEGSTVIVGLNALRLLKS

SEQ ID NO: 871 - protein, 274 aa, Chlamydia pneumoniae
  CPn0869
EGWRFFFPKTSENTSDCRQHQILRKIMTQDPHDHFKSRTPEDHIKHVRDKHRVCKGEPHTTFKGFFYHLANNALSTGVFIFFIRTLFFLIPTNRALQVKSLISLGVGWTFYHGCLKARKAWAYMELSHRSMLEEKNEIEENFEQEKIELRILFENQGFKDPLLQEMVEYVCSDSTLLLDTMIREELYIRKEDLPHPLIQGGSRILGGLCGLAIFLPLVLCISYTLAGVFSALMVLVLSFLKAKILKNDKISEMVWVLGIFITSASIISSLMKLL

SEQ ID NO: 872 - protein, 478 aa, Chlamydia pneumoniae
  CPn0870
TTTHPTQGFGGAVILPFSPISIARRIKKSCCSEKSSIYSHFCTLLLNNETSMLDIKIIRKTPEECETRLRKKDPKISLEPVLSLDKEVRQLKTDSETLQAQRRLLSQDIHKAKTQGVDATNLIQEVETLAADLEKIEQHLDQKNAQLHELLSHLPNYPADDIPVSEDKAGNQVIKSVGDLPIFSFPPKHHLELNQELDILDFQAAAKTTGSGWPAYKNRGVLLEWALLTYMLQKQAAHGFQLWLPPLLVKKEILFGSGQIPKFDGQYYRVEDGEQYLYLIPTAEVVLNGFRSQDILTEKELPLYYAACTPCFRREAGAAGAQERGLVRVHQFHKVEMFAFTTPNQDDIAYEKMLSIVEEMLTELKLPYRLSLLSTGDMSFTASKTIDAEVWLPGQKAFYEVSSISQCTDFQSRRSGTRYKDSQGKLQFVHTLNGSGLATPRLLVAILENNQQADGSVVIPEVLRPYLGGLEILLPKDQ

SEQ ID NO: 873 - protein, 378 aa, Chlamydia pneumoniae
  CPn0871
EYMEDFSEQQLFFMRRAIEIGEKGRITAPPNPWVGCVVVQENRIIGEGFHAYAGGPHAEELAIQNASMPISGSDVYVSLEPCSHFGSCPPCANLLIKHKVSRVFVALVDPDPKVAGQGIAMLRQAGIQVYVGIGESEAQASLQPYLYQRTHNFPWTILKSAASVDGQVADSQGKSQWITCPEARHDVGKLRAESQAILVGSRTVLSDDPWLTARQPQGMLYPKQPLRVVLDSRGSVPPTSKVFDKTSPTLYVTTERCPENYIKVLDSLDVPVLLTESTPSGVDLHKVYEYLAQKKILQVLVEGGTTLHTSLLKERFVNSLVLYSGPMILGDQKRPLVGVLGNLLESASPLTLKSSQILGNSLKVVWEISPQVFEPIRN

SEQ ID NO: 874 - protein, 438 aa, Chlamydia pneumoniae
  CPn0872
KERIFRVACLASESVNARESMIETREEVGSANFVSLERAIEDLRAGKFVIVVDEASREDEGDLIIAGEKITVEKMTFLLQHTTGVVCAALSQERLLSLDLPPMVKDNRCRFKTPFTVSVDAAHGVTTGVSAADRTKVVQLLADPKSKPEDFISPGHFFPLASSPGGVLKRAGHTESTVDLMELAGLQPCGVLAELVNEDYSMMRLPQILEFARKHNIAVIPVTSIIAHRMLSDRLVSKISSARLPTIYGDFTIHVYESLLEGMQHLALVKGNVAGKSNVLVRVHSECVTGDILGSKRCDCGEQLSSAMSYIAEKGTGVLVYLRGQEGRGIGLGHKVRAYALQDNGYDTVDANLAMGFPVDSREYGIGAQILVDLKLTTIKLITHNPQKYFGLQGFGLSITERVPLPVRISEDNEQYLRTKQERMGHWLDLPCCNNRVQ

SEQ ID NO: 875 - protein, 169 aa, Chlamydia pneumoniae
  CPn0873
ISHAVTIGYNNFEEYMKTLKGHLSAKNLRIAIVGSCFNQAMADALVSGTQETFLKFGGSEDGLMTIRVPGAFEIPCTIKKLLSSERKFDAIVACGVLIQGETDHYNQIVNQVAAGIGALSLEFCLPITLSIVAAPSAEIAWQRSGIKGRHLGVSGMTTAIEMATLFTQI

SEQ ID NO: 876 - protein, 472 aa, Chlamydia pneumoniae
  CPn0874
LISLNLKILTKQRDREEASMLKILKIKVLVFPLALLMGCNSIGYAGPQGSLQTNSQTKVKIGSEVWIEQKLRQYPELLWLTESGGAPLLTSTPIDMAYSEKLFNKKVPALDIAIRSMIHLHLLIQGSRQSYMQLSQILPSEEGGMTFKQFQTAHKQLLFFLNSPKSFDNTLRILETAIVLRHVGCSAKAVTTFKPYFTDSCPQSFYAKALHVLRTFPELCPSYARLSPEQQEVLLSLRRLGNYDSLLNLTEVPSAQLLSAWRTRRSLAILDLYLYCLDTCGDKNCSQEFYINFAPLLSMLQQHATIEEAFSRYFTYRANRLGFEGTSRTDMTLVRLATLMNLSPSEASTLAWSFKNLPSDEAENLVNSFYTVQGEHIPLTFRGLPSLVAGLSVATHGSTVSPENRLRQLYSTMLSLLVKSLRSHREMLNKQLLPQGTVLDFSETTLSSGGLDVFAESIAVRIHLNGAVSINL

SEQ ID NO: 877 - protein, 220 aa, Chlamydia pneumoniae
  CPn0875
LKIMKRVIYKTIFCGLTLLTSLSSCSLDPKGYNLETKNSRDLNQESVILKENRETPSLVKRLSRRSRRLFARRDQTQKDTLQVQANFKTYAEKISEQDERDLSFVVSSAAEKSSISLALSQGEIKDALYRIREVHPLALIEALAENPALIEGMKKMQGRDWIWNLFLTQLSEVFSQAWSQGVISEEDIAAFASTLGLDSGTVASIVQGERWPELVDIVIT

SEQ ID NO: 878 - protein, 465 aa, Chlamydia pneumoniae
  CPn0876
SIATGETMLYFIEQLNKLSTSFCVFPMILLLGGFLTWKLRGLQFHGLKLGFNLMLQNKLDDSSSKANEVSSYEAVAGILAGNFGTGNIAGMAVALACGGPGALVWVWLAALLGAIVQYAGSYLGSKYRKPEGNTGEFIGGPIACLAFGMRKKILAGFFALFTIMTAFCAGNCVQVSCIVPLCAEGTPGKLLVGILLALVVIPVLAGGNNRILRFSARVIPFIAGFYCISCGIILFQHASAILPAIKLICSSAFGIKAGLAGIGGYTLSQVISTGINRAVMATDCGSGMVSILQANTKSKNPVVDGLVTLVPPVIVMVVCSITMLVLIVSGAYSSGAQGTLMVMSAFKNSLGSLGSVIVILAMALFGYTTILTWFACAEKSLQYMIPGRRANLWLKAIYVLIIPLGGVIDMRMIWALSDTGFSGMVILNCIALIALLKDVLSTNRDVALLKERECSVADPVRNLDA

SEQ ID NO: 879 - protein, 154 aa, Chlamydia pneumoniae
  CPn0877
RRRIMQLLSPAFAYGAPIPKKYTCQGAGISPPLTFVDVPGAAQSLALIVEDPDVPKEIRSDGLWIHWIVYNLSTTITNLAEGAEIFAVQGLNTSGKPVYEGPCPPDKQHRYFFTLFALDVVLPEEENVTRDQLYEAMEFHIIEQAELMGTYEKS

SEQ ID NO: 880 - protein, 223 aa, Chlamydia pneumoniae
  CPn0878
GCMSTVTTEPCSSIHISLNNDWRDSQPYSLDRASELLHFRFLPSLVFSNWKVEQQIETLCHKSEKRRLISPLAKWLGKLHKQDLLCPPAPPVSVCWINAHVGYGVFARDEIAPWTYIGEYTGILRHRQAIWMDENDYCFRYPMPLFTLRYFTIDSGKQGNVTRFINHSEQPNAEAIGVFSEGLFHVIIRTVAPIYAGQEICYHYGPLYWKHRKKREEFIPEEE

SEQ ID NO: 881 - protein, 273 aa, Chlamydia pneumoniae
  CPn0879
YRILWKVSMQGFFPLASGSKGNSAYLGTDSCKILIDLGVSKQVVTRELLSMNIDPEDIQAIFVTHEHSDHISGIKSFVKAYNTPIVCNLETARALCHLLDSHPEFKIFSTGSSFCFQDLEVQTFNVPHDAVDPVAFIFHYREEKLGFCTDLGWVTSWITHELYDCDYLLIESNHSPELVRQSQRPDVYKKRVLSKLGHISNQECGQLLQKIITPKLKKLYLAHLSTECNTAELALSTVSESIASITSIAPEIALAQGITSPIYFSRLEVACPR

SEQ ID NO: 882 - protein, 807 aa, Chlamydia pneumoniae
  CPn0880
PMIRERKKSRHPRLPTLPLAAKASLYLFFACFSGLSLWSFHRDQPCTQNWIGLLGWSFSSFLLYFFGAAAFFIPLYFLWLSFLYFRRTPRPLFFYKAAAFLSLPFCSAILLSMLSPVGTLPALLDTRLPKFILGNNPPVSYVGGIPFYLFYEGQSFCLKHLIGSVGTALIFGFVMLFSVLYLCGGIALLKKKTFQDGVKKAFCSFFQTCFKNLKKLINRRNYLPKPSVPFVSKNPFSCTKSQPSPRRVSETIILDGSISPLPQEEIPGSKKESFFLTPHPCKRFLTKFVEPQENKAKEGKTIALSSTPTVVRESKGKERAALPKLKSLAVPENDLPQYHLLSKNREARPESLQAELERKALILKQTLTSFGIDADLGNICSGPTLAAFEVLPHSGVKVQKIKSLENDIALKLQASSIRIIAPIPGKAAVGIEIPTPFPQAVNFRDLLEDYQKTNRKLQIPLLLGKKANGDNLWADLATMPHLIIAGTTGSGKSVCINTIVMSMIMTTLPSEIKLVIIDPKKVELTGYSQLPHMLSPVITESREVYNALVWLVKEMESRYEILRYLGLRNIQAFNSRTRNKTIEASYDREIRETMPFMVGIIDELSDLLLSSSQDIETPIIRLAQMARAVGIHLILATQRPSREVITGLIKANFPSRISFKVSNKVNSQIIIDEPGAENLMGNGDMLVLLPSVFGTIRAQGAYICDEDINKVIQDLCSRFPTQYVIPSFHAFDDSDSDNSGEKDPLFAQAKTLILQTGNASTTFLQRKLKIGYARAASLIDQLEEARIIGPSEGAKPRQILIQNPLEG

SEQ ID NO: 883 - protein, 188 aa, Chlamydia pneumoniae
  CPn0881
NKKFAVHMPVPIDNSSRNLQEVPESLEDLEQHAEESPTHQSAESSSLQLSLASSAISSRVEQLSSLVLGMENSDFSSLRDVPIFSAIYESSTHTPVPTPLVGVGYINGSQSGYYDTQRESLHLSQLLGSRRVEVVYNQGNFMEASLLNLCPRRPRRDPSPISLALLELWEAFFLEHPPGSTFNPIFFW

SEQ ID NO: 884 - protein, 412 aa, Chlamydia pneumoniae
  CPn0882
NTPQVALLIQYFFGNGAFYVREALRLTPHAQNIVLVGICPSLYPEHPRSFYYRVSGDIGSRFDDRGFVNSGVETLPYSSGSFGIFWISFTDPTFNFAIVNTFMRTAGINEVSRPMTQDTETSLIEMRDLSEQQEANNTDSLEQEESLMGIVGHTVGGVSMTVTSSPNIFYRIQTLLGLPETLAEAEENPTFPNSTIDSLAEIMMNLVRISDAVSIFWIFPIVDTTYNGVLLAVCIGFFGINGICSTFLMLTNPRSRRDRWRNLRIMVLCYRSLGSGMNLFDLSNNVRMAARRHVTSCTVALYAMVTLFGWTVAIQDALQYGFPSVRDAFYRYCLRHRYCLTQRNEDSLQTTGTRFQVTRTHLEDQQMVASILNLSVFGLFFGFVGLMTTFGGLEISPSCRWDAANNRTVGIF

SEQ ID NO: 885 - protein, 444 aa, Chlamydia pneumoniae
  CPn0883
LYELFIKSGIFIVMTWLSGLYFICIASLIFCAIGVILAGVILLSRKLFIKVHPCKLKINDNEELTKTVESGQTLLVSLLSSGIPIPSPCGGKATCKQCKVRVVKNADEPLETDRSTFSKRQLEEGWRLSCQCKVQHDMSLEIEERYLNASSWEGTVISNDNVATFIKELVVAVDPNKPIPFKPGGYLQITVPSYKTNSSDWKQTMAPEYYSDWEHFHLFDQVIDNSQLPADSANKAYSLASYPAELPTIKFNIRIATPPFINGKPNSEIPWGVCSSYVFSLKPGDKITVSGPYGESFMKDDDRPLIFLIGGAGSSFGRSHILDLLLNKHSKREIDLWYGARSLKENIYQEEYENLERQFPNFHYHLVLSEPLPEDIAAGWDKDDPTKTNFLFRAFNLGQLSRLDNPEDYLYYVCGPPLHNSSILKLLGDYGVERSSIILDDFGS

SEQ ID NO: 886 - protein, 120 aa, Chlamydia pneumoniae
  CPn0884
GDCMLSRIVTCFLFLLSSLPLFAEEEAAQSKNTFVQPAVMLAIAILFFYFILWRPEQKRRKAMEKRKNDLAKGDKVTAMGIIGTVDDIREHTVILNIASGKVEVLKGAISEILKPNDNKS

SEQ ID NO: 887 - protein, 406 aa, Chlamydia pneumoniae
  CPn0885
ASILTMSTMQNCPHFGVCGGCSFPQSNYSDSLKKKEELLHQLFAPLVPSDMIAPIIPCSPSLRGRNKMEFSFFQTYEGEKSLGFISSTKPKKGIPVTTCLLIHEQTMDILKLTREWWDKHPELMAYFPPKNKGSLCTLTVRTGSPQQNFMVILTTSGTPEYRVNEACIDEWKEILLSSSLNIASIYWEEKVAARGISTYYETKLLYGAPSIQQKLSLPSDGNSASFSLRPRSFFQPQITQAAKIIETAKEFINPEGSETLLDLYCGAGTIGIMLSPYVKNVIGVEIIPDAVASAQENIKANNKEDCVEVYLEDAKAFCKRNENCKAPDVIIIDPPRCGMQSKVLKYILRIGSPKIVYISCNPKTQFQECADLISGGYRIKKMQPIDQFPYSTHLENIILLEREIDP

SEQ ID NO: 888 - protein, 127 aa, Chlamydia pneumoniae
  CPn0886
RTLFMALKDTAKKMKDLLDSIQHDLAKAEKGNKAAAQRVRTDSIKLEKVAKLYRKESIKAEKSGLLKRKPSTKAPAKVKKTAEKKAPKKSSAAAAKTSKAVKASKPASKKTAAKKVKKPSKARGFRK

SEQ ID NO: 889 - protein, 822 aa, Chlamydia pneumoniae
  CPn0887
MKKLYHPTLFLRPLIRLSLIFALSLTLISGNFPQQKSFGHCCADMHSALISGKNCEELFADFIERVLADRETLTARDWGTVVVLVREYLLKCIRKGDCDYGVKILQKLLALRLPKDARKDLQILWHRLNPEQAPLRDVVDQLFTIGCHESLQDHLLFELYTVTLHSGYENRKQDMLLAKEQGDYKKAIELAKELVAALEKGSCSPHPEIVQIEKTFLQKTLLALQIKVAQEAQESCDALLTPYCLSEIAYTEAMDALVLRIARGEVSRTNEVDSVLLSHALQHLPFAREKAIPELEVLIDHGAYLESTLLYYAYFSLLELYHQNKDFASLERLLEKGDAVFVPEHPYFPEYGFFLGAYFYAKGKYESAEKVFLQIIDPAVKLGATFARAYEYLGCIAYVQNHYEKAEEYFLRAYKSWGREESGIGLFLAYAVQKKKTACEDMLYHPKFSFTYRHLLDSLCSLSYPHGENKGSSAIQRVHRAVPELSEIYSRCIYDMIKYRNVTYTHPIIELAYNQVRNLEKRNLEEICRDAQDPEYDKALAFWGALQSGASVPRSLIESSDVDEARITIRCYEALYFHNPDAIAMLPQAFSEECNSWQTALRLVWTLVRPKGAPNHAKYWDHLVLRPHGDSLYFFGYDLQEYLIGKEDALKHLSVFAELFPKSSLLSLVYYLQGYSESSALRKVGWFVKALEEFTEISWSGEHMKTWAYIYYMVKLDLADTYISLGNFSQAVHILEEVKEDWQVASHPKLHFLKGEDCYLAMELRWVEGLAYAYFQLHETAHLSNHLLEHVEKNLISPRSYRDYYGESLQRTLGLCQRFLGV

SEQ ID NO: 890 - protein, 441 aa, Chlamydia pneumoniae
  CPn0888
AERRFCVKRAIIIGAGISGLAAGWWLHKKFPQAEILVLDKEAYAGGFVRTESPQGFSFDLGPKGFLTRGDGEYTLKLIHELGLQNSLIFSDRAAKNRFVYYRGKAHKISTWTLLRKGLLPSLIKDFRAPCYTQDSSVQDFLKRHSSQNFTSYILDPLITAIRAGHSSILSTHMAFPELAKREASSGSLLRSYLKNRSPKKSKTDRYLASLSPSMGTLITTIQEKLPATWKFSTSVTHIDCSPKEACVTTPSETFFADMVIYTGPLQQLPVLLPNYGIENLSKRVLPWNLSSISLGWHHANFSLPKGYGMLFADELPLLGIVWNSQIFPQATPGKTVLSLLIEGKWRESEAHAFAIAALSEYLNINQKPDAFALFSSQDGMPQHAVGFLERKERILPHLPGNLKIVGQNIAGPGLNRCIASAYHAICDLHTEETLAQPQSSL

SEQ ID NO: 891 - protein, 460 aa, Chlamydia pneumoniae
  CPn0889
FLMFNVNFKFLEGLHQPAPRYTSYPTALEWEPSDAAPALLAFQRIRENPQPLSLYFHIPFCQSMCLYCGCSVVLNRREDIVEAYINTLIQEMKLVVETIGFRPQVSRIHFGGGTPSRLSRELFTLLFDHIHKLFDLSHAEEIAIEVDPRSLRNDMEKADFFQNVGFNRVSLGVQDTQADVQEAVRRRQSHEESLKAYEKFKELAFQSINIDLIYGLPKQTKESFSKTIQDILAMYPDRLALFSFASVPWIKPHQKAMKASDMPSMEEKFAIYSQSRHLLTKAGYQAIGMDHFSLPHDPLTLAFKNKTLIRNFQGYSLPPEEDLLGLGMTSTSFIRGIYLQNAKTLEEYHNTVLRGTFATVKSKILTEDDRIRKWAIHKLMCTFTINKEEFFNLFGYEFDTYFIESRDRLISMETTGLIHNSPGSLKVTPLGELFVRVIATAFDHYFLNKVSKKECFSASI

SEQ ID NO: 892 - protein, 337 aa, Chlamydia pneumoniae
  CPn0890
STLHNWDSMSAFFDLLKSQTASHPPIWLLRQVGRYMPPYQELKGSQSLKTFFHNTEAIVEATLLGPSLLHVDAAILFADILSILDGFAVTYDFAPGPRIQFSPEQPFTFTSDPQTIFSYLLDAIRTLKQKLPVPLIVFAASPFTLACYLIDGGASKDFSKTMSFLYVYPEKFDQLISTIIEGTAIYLKTQMDAGAAAVQLFESSSLRLPSALFTRYVTEPNRRLIAKLKEQAIPVSLFCRCFEENFYTLQATQADTLHPDYHVDLHRIQKNLMLSLQGNLDPAIFLLPQEKLLHYVEAFLVPLRTYPNFIFNSGHGILPETPLENVQLVVSYVQRQL

SEQ ID NO: 893 - protein, 1087 aa, Chlamydia pneumoniae
  CPn0891
NFMAMDFNPVNLDFSISKEFKEETLPLLLENIHPGATAFLAAKMFHDCRASVIMITTPARLDDLFENLRTFLDQAPVEFPSSEIDLSPKLVNIDAVGKRDHLLYSLNQHRAPIFCVTTLKALLEKTRSPQATSQQHLDLAVGDVLDPEATTELCKSLGYSQVMLTSEKGEFSCRGGIVDIFPLSSPEPFRIEFWGEKIISIRSYNPSDQLSTGKVSKISISPAYTEEASGGNYSHSLLDYFSTPPLYLFDNLEILEDDFADISGTLSSLPDRFFSIGTLYDRISTSNQVYFSETPFPNVKNLKENRVIIEAFHRNMEASRQAIPILYPEQIIQNDENPLLAFLQHLQEYMPPHGKPLKLAIYSTKTKSLKEARALAETVARGDVEIYEKTGNLTSSFALVNEAFAAISLSEFASTKVLRRQKQRTHFSVTTEEVFVPIPGETVVHIHNGIGKFLGIEKKPNHLNIETDYLVLEYADKARLYVPSNQAYLISRYVGTSDKAADLHHLNSSKWKRSRDLTEKSLIVYAEKLLQLEAQRSTTPAFVYPPHGESVIKFAETFPYEETPDQLKTIDQIYNDMMSPKLMDRLICGDAGFGKTEVIMRAAVKAVCDGHRQVIVMVPTTILATQHYETFKERMAGLPIEIAVLSRFSQAKVQKLICEQVASGQIDIIIGTHKLINKSLEFKNPGLLIIDEEQRFGVKVKDNLKERYPMIDCLTVSATPIPRTLHMSLSGARDLSVIAMPPLDRLPVSTFVMEHNTETLTAALRHELLRGGQAYVIHNRIESIYTLAETIRNLIPEARIGVAHGQMGAEDLSNIFTKFKNQKTDILVATALIENGIDIPNANTILIDHADKFGMADLYQMKGRVGRWNKKAYCYFLVPHLDRLSGPAAKRLAALNKQEYGGGMKIALHDLEIRGAGNILGTDQSGHIGTIGFNLYCKLLKKAVSALKKHTSPLLFNDDVKIEFPYNSRIPDTYIETGSMRIEFYQKIGNAESSEELTAIQEEMRDRFGPLPQEICWLFALAEIRLFALQHGISSIKGTANALYVQKCLSKSEQTKKTLPYALSPTPELLVKEVIESIERGFLINAS

SEQ ID NO: 894 - protein, 876 aa, Chlamydia pneumoniae
  CPn0892
EFFFMLSNTIRSNFLKFYANRHHTILPSSPVFPHNDPSILFTNAGMNQFKDIFLNKEKVSYSRATTSQKCIRAGGKHNDLDNVGHTSRHLTFFEMLGNFSFGDYFKAEAIAFAWEVSLSVFNFNPEGIYATVHEKDDEAFALWEAYLPTDRIFRLTDKDNFWSMANTGPCGYCSELLFDRGPSFGNASSPLDDTDGERFLEYWNLVFMEFNRTSEGSLLALPNKHVDTGAGLERLVSLIAGTHTVFEADVLRELIAKTEQLSGKVYHPDDSGAAFRVIADHVRSLSFAIADGLLPGNTERGYVLRKILRRSVNYGRRLGFRNPFLAEIVPSLADAMGEAYPELKNSLSQIQKVLTLEEESFFKTLDRGGNLLQQVLKSSSSSSCISGEDAFKLKDTYGMPIDEISLLAKDYDYSVDMDTFHKLEQEAKERSRKNVVQSQGTSESIYNELHLTSEFIGYDHLSCDTFIEAIISKDHIVSSLQEKQEGAIVLKVSPFYAEKGGQVGDSGEIFCSEGTFIVTHTTSPKAGLIVHHGRISQGSLTVEAAVTAQVNRYRRKRIANNHTACHLLHKALEITLGDHIRQAGSYVDDTKIRLDFTHPQAISPEDLLCIETLVNESIRENEPVDIREALYSDVMNSSEIKQFFGDKYSDVVRVVSAGHSHELCGGTHAEATGDIGFFRITKEHAVAMGIRRIEAVTGEKAEATVHQQSEVLEEIATLLQVPRDQIVSRLTATLDERKQQDKRLNELENSLIQTKLDKLIHNCHQRQGITCLVHHLAEHENHRLQQYAQCLHQRIPEKLISLWTTEKNGKYIVLSRVSDDLITQGVHAQDLLKAVLTPCGGRWGGKDQSAQGSAPALPATEVLNETLWQWISTQLI

SEQ ID NO: 895 - protein, 689 aa, Chlamydia pneumoniae
  CPn0893
EFLAFCLGISYSCCFYIEGLQGLLMINKELDIGILGKIAGAIKQISIESIQKASSGHPGLPLGCAELAAYLYGYVLRQNPRDPHWINRDRFVLSAGHGSALLYSCLHLAGFDVSLEDLQEFRQLHSRTPGHPEYGETVGVEATTGPLGQGLGNAVGMALSMKMLESRFNRPGHEIFNGKIYCLAGDGCFMEGVSHEVCSFAGSLNLNNLVVIYDYNNVVLDGYLNEISVEDTKKRFEAYGWDVYEIDGYDFTHIHETFSSIKRGQERPVLVIAHTIIGHGSPKEGTNKAHGSPLGVEGTHETKQFWHLPEEKFFVPPAVKNFFAHKIQEDRKAQEQWLDEVRVWSKQFPELHEEFVALTSHKLPKNLESLVQSVEMPDSIAGRAASNKLIQVLVQHIPYLIGGSADLSSSDGTWIANEKVIHTYDFSGRNIKYGVREFGMATIMNGLAYSQVFRPFGGTFLVFSDYMRNAIRLAALSKLPVIYQFTHDSIFVGEDGPTHQPVEQLMSLRAIPGLYVIRPADANEVRGAWIAGLKHTGPTVIVLSRQALPTLPAAHRPFKDGIGRGAYIVLKESGEKPDYTLFATGSEVSLALSVAKELEHLDKQVRVVSFPCWELFEAQDVDYKQSIVGGDLGIRVSIEAGSALGWYKYIGSEGLAIAMDRFGYSGASDDVSEECGFTTEQILQRILSQ

SEQ ID NO: 896 - protein, 312 aa, Chlamydia pneumoniae
  CPn0894
PRNDKNAKNLRRKHYKGERVSKHTSESRIAQDMLERYSGSSVKQFCPYLLLTNFSYYIQTFAKLHGVPVFEGSMFSAAHAPHLKTSILDFKLGSPGAALTIDLCSFLPDLKAALMLGMCGGLRSHYQVGDYFVPVASIRGEGTSDAYFPPEVPALANFVVQKATTEVLEDKKANYHIGITHTTNIRFWEFNKKFRKKLYETKAQSAEMECATLFAAGYRRNLPIGALLLISDLPLRKEGIKTKSSGNFIFNTYTEDHILTGQEVIENLEKVMLKRAASDHKKDQQYRGLPHMEVGEADDTMASGSETSDSDY

SEQ ID NO: 897 - protein, 195 aa, Chlamydia pneumoniae
  CPn0895
EIDCFMVRVSTSEFRVGLRIEIDGQPYLILQNDFVKPGKGQAFNRIKVKNFLTGRVIERTYKSGESVETADIVERSMRLLYTDQEGATFMDDETFEQEVVFWEKLENIRQWLLEDTIYTLVLYNGDVVAVEPPIFMELSIAETAPGVRGDTASGRVLKPAVTNTGAKIMVPIFIDEGELVKVDTRTGSYESRVSK

SEQ ID NO: 898 - protein, 83 aa, Chlamydia pneumoniae
  CPn0896
EKYFFFTVRNMEAKKIKELSKEAQLLKKLREKSRVLDEKNKRKAWVAKLVAMPESIREIEKEERVETPQLFQAIAEKILEEGV

SEQ ID NO: 899 - protein, 314 aa, Chlamydia pneumoniae
  CPn0897
NFSLDSNTVDQKNKSNPRPMQEKPRHVHRIIHISDVHFHVLPVNPVHCFNKRLKGLLRKVFGLVHFQATTIGQRFPKVVRSLGADSVCITGDFSLTAMDGEFLLAKHFVETLAKHSSVYLLPGNHDVYTLKSLAQQTFYTHFPNDQLQQNKVSFHKITDHWWLILLDCSCLNGWFSANGVVHLAQISAIETFLLSLSPEENVIIANHYPLLSSQNPSHDLINNTHLQNVLKKYPKVRLYLHGHEHQAAVYNCADTSPSYILNSGSISLPTNSRFHVIDLYPEKYQVHTMILKNLLDFDAPLEIANEATWDCQKL

SEQ ID NO: 900 - protein, 536 aa, Chlamydia pneumoniae
  CPn0898
TKKRLGSVKILRLLGVCMSEQEKLSNYNADKKLFSGIDKLFQIVKGSYGPKQSLSPTSFFKERGFYAISQTELSNSYENLGVDFAKAMVNKIHKEHSDGATTGLILLHAILQESYAALEKGISTHKLIASLKLQGEKLQEALQQQSWPIKDALKVRNIIFSSLHMPTIADHFYNAFSVVGPEGLISITKERENDKTSMDVFQGFKIPAGYASTYFVSDTASRLTRIAHPLILITDRKISMIHSLLPLLQEISEQNQHLIIFCEDIDPDVLATLVVNKLQGLLQVTVVTIPQLSTTNQELAEDIALFTGTHICPCQEASHVLAPEMVTLGSCLSIEISESQTTLIGGLHIPEVLTLKTRQLAEEIRTTSCLETKKRLIKSTNRLQSSVAILPTDEDNEPLYTLALKIMESALSRGYVPGGGVALFYASLTLGTPKDDADENSIAISLLQKACCAPLKLLATNADLDGDAVIAKLSSLGTTSLGISVFSREIEDLIAGGILDSLATTSTILAQALDTAILVLSSKILILENQYEISTL

SEQ ID NO: 901 - protein, 456 aa, Chlamydia pneumoniae
  CPn0899
NHRCCRQNYMRAMLLEDWVSLMLSDVSCPKCDKKITGFAIDSQQVQPGDLFFALPGNATDGHQFLKHAATAGAVAAVVSHDYQGDSFGLELIRVDDTKSALQEAGSNQCNLFQGTLVGITGSVGKTTTKEFSKTILSSIYKTHASPKSYNSQLTVPLSLLMAEGDEDVMILEMGVSEPGNMQDLLRIVQPEIAVITHINDQHAMHFPQGIQEILKEKSYILQKSKLQLLPKDSPYYLDLRSCSPTAEKFSFSFNDPLADFCYKAISGDSVVIQTPEENYCLPIAFSYKPAYTNLLIAVALSWILEVPEEGVIRSLPELKLPPMRFEHSMRNGMQVINDAYNACPEAMIAALDALPLPSDGGKIILILGHMAELGRYSEEGHALVAEKAASRGDMIFFIGEKWIPVQSVLKSYSCEVSFFSSAQDVKDILKQVARYGDVILLKGSRALALESLLACF

SEQ ID NO: 902 - protein, 358 aa, Chlamydia pneumoniae
  CPn0900
LVFNFLGASMIPLIPMFLKQSLFFSLALTGMTTLVLTVALGVPVMKWLKRKNYRDYIHKEYCEKLEMLHKDKAEVPTGGGVLLFISLIASLLVWLPWGKFSTWFFIILLTCYAGLGWYDDRIKIKRKQGHGLKAKHKFMVQIAIAAFTLIALPYIYGSTEPLWTLKIPFMEGMLSLPFWLGKVFCLGLALVAIIGTSNAVNLTDGLDGLAAGTMSFAALGFIFVALRSSTIPIAQDVAYVLAALVGACIGFLWYNGFPAQLFMGDTGSLLLGGLLGSCAVMLRAECILVVIGGVFVAEAGSVILQVLSCRLRKKRLFLCSPLHHHYEYQGLPETKIVMRFWIFSFVCAGLGIAAVLWR

SEQ ID NO: 903 - protein, 433 aa, Chlamydia pneumoniae
  CPn0901
FCMRRSRYSGCLMEIDMCQRILILGTGITGKSVARFLYQQGHYLIGADNSLESLISVDHLHDRLLMGASEFPENIDLVIRSPGIKPYHPWVEQAVSLKIPVVTDIQVALKTPEFQRYPSFGITGSNGKTTTTLFLTHLLNTLGIPAIAMGNIGLPILDHMGQPGVRVVEISSFQLATQEEHIPALSGSVFLNFSRNHLDYHRNLDAYFDAKLRIQKCLRQDKTFWVWEECSLGNSYQIYSEEIEEILDKGDALKPIYLHDRDNYCAAYALANEVGWVSPEGFLKAIRTFEKPAHRLEYLGKKDGVHYINDSKATTVTAVEKALMAVGKDVIVILGGKDKGGDFPALASVLSQTTKHVIAMGECRQTIADALSEKIPLTLSKDLQEAVSIAQTIAQEGDTVLLSPGCASFDQFQSFKERGAYFKLLIREMQAVR

SEQ ID NO: 904 - protein, 245 aa, Chlamydia pneumoniae
  CPn0902
AVDQRNAGSEVNMNRRDMVITAVVVNAILLVALFVTSKRIGVKDYDEGFRNFASSKVTQAVVSEEKVIEKPVVAEVPSRPIAKETLAAQFIESKPVIVTTPPVPVVSETPEVPTVAVPPQPVRETVKEEQAPYATVVVKKGDFLERIARANHTTVAKLMQINDLTTTQLKIGQVIKVPTSQDVSNEKTPQTQTANPENYYIVQEGDSPWTIALRNHIRLDDLLKMNDLDEYKARRLKPGDQLRIR

SEQ ID NO: 905 - protein, 391 aa, Chlamydia pneumoniae
  CPn0903
SKQSLSMKWFVISCLLGIFSLGLIMVFDTSSAEVLDRSLECSTHKALIRQVTYLILGLGVASLLYMMEWRDFLKISPVLLSGAALALICVFIPGLGICRNGARRWLGFGQLTIQPSEFVKYLVPIVALYFLTFSSLYQKQLKMFLKLTAILFIPILLIAIEPDNGSAAVISASLIPVFIMTSVRLRYWLLPLLCVLIAGGALAYRMPYVRYRLNVYLHPELDIKGRGHQPYQAKIAAGSGKLLGKGPGASLQKLTYLPEAQNDYIAAIYAEEFGFLGMLVLILLYMCFVYGGYAIAIKASSLEGAALAMVITLIISMQAFMNLGVVSGLLPSKGVNLPFFSQGGSSLIANMCGVTLLLKVYDEENSKSSLGCRRFRRPHCPSSLGKGSFFS

SEQ ID NO: 906 - protein, 359 aa, Chlamydia pneumoniae
  CPn0904
RYMMKKIRKVALAVGGSGGHIVPALSVKEAFSREGIDVLLLGKGLKNHPSLQQGISYREIPSGLPTVLNPIKIMSRTLSLCSGYLKARKELKIFDPDLVIGFGSYHSLPVLLAGLSHKIPLFLHEQNLVPGKVNQLFSRYARGIGVNFSPVTKHFRCPAEEVFLPKRSFSLGSPMMKRCTNHTPTICVVGGSQGAQILNTCVPQALVKLVNKYPNMYVHHIVGPKSDVMKVQHVYNRGEVLCCVKPFEEQLLDVLLAADLVISRAGATILEEILWAKVPGILIPYPGAYGHQEVNAKFFVDVLEGGTMILEKELTEKLLVEKVTFALDSHNREKQRNSLAAYSQQRSTKTFHAFICECL

SEQ ID NO: 907 - protein, 812 aa, Chlamydia pneumoniae
  CPn0905
VHYMKGTPQYHFIGIGGIGMSALAHILLDRGYEVSGSDLYESYTIESLKAKGARCFSGHDSSHVPHDAVVVYSSSIAPDNVEYLTAIQRSSRLLHRAELLSQLMEGYESILVSGSHGKTGTSSLIRAIFQEAQKDPSYAIGGLAANCLNGYSGSSKIFVAEADESDGSLKHYTPRAVVITNIDNEHLNNYAGNLDNLVQVIQDFSRKVTDLNKVFYNGDCPILKGNVQGISYGYSPECQLHIVSYNQKAWQSHFSFTFLGQEYQDIELNLPGQHNAANAAAACGVALTFGIDINIIRKALKKFSGVHRRLERKNISESFLFLEDYAHHPVEVAHTLRSVRDAVGLRRVIAIFQPHRFSRLEECLQTFPKAFQEADEVILTDVYSAGESPRESIILSDLAEQIRKSSYVHCCYVPHGDIVDYLRNYIRIHDVCVSLGAGNIYTIGEALKDFNPKKLSIGLVCGGKSCEHDISLLSAQHVSKYISPEFYDVSYFIINRQGLWRTGKDFPHLIEETQGDSPLSSEIASALAKVDCLFPVLHGPFGEDGTIQGFFEILGKPYAGPSLSLAATAMDKLLTKRIASAVGVPVVPYQPLNLCFWKRNPELCIQNLIETFSFPMIVKTAHLGSSIGIFLVRDKEELQEKISEAFLYDTDVFVEESRLGSREIEVSCIGHSSSWYCMAGPNERCGASGFIDYQEKYGFDGIDCAKISFDLQLSQESLDCVRELAERVYRAMQGKGSARIDFFLDEEGNYWLSEVNPIPGMTAASPFLQAFVHAGWTQEQIVDHFIIDALHKFDKQQTIEQAFTKEQDLVKR

SEQ ID NO: 908 - protein, 199 aa, Chlamydia pneumoniae
  CPn0906
KWGSEVLELVNDSQLSREASAFRLDIDFFILNIYPFFRNFKNIELCFFLSISQFNLDMEEFVAYIVKNLVTNPEAVEIRSIEDEDNESIKLEIRVAAEDIGKIIGRRGNTIHALRTILRRVCSRLKKKVQIDLVQPENGTDVIADQDYICDNDSSNSTEDTFGESDTCCSGHCHYDEDLNQEEQEEGNMHHSCECSNHH

SEQ ID NO: 909 - protein, 124 aa, Chlamydia pneumoniae
  CPn0907
FAFSKFLIIKSSMTAVLILTSFPSEESARSLARHLITERLASCVHVFPKGTSTYLWEGKLCESEEHHIQIKSIDIRFSEICLAIQEFSGYEVPEVLLFPIENGDPRYLNWLTILSYPEKPPLSD

SEQ ID NO: 910 - protein, 276 aa, Chlamydia pneumoniae
  CPn0908
ILAILFMIIIKNNELMIRRFFKTLFPPGPQYSLCYASILIVLSSLVCVPTFCWLFLPELSLSKFNPSPIRNLFLVSSTLSKVPPTAIAEHLRLSADAPTYLHEFSIKEAESSLHALGIFSSLVIEKSPDNKGITIFYTLQTPIAYVGNRSNTLCNLEGSCFLGQPYFPSLNLPQIFFSQEDLKMQKLPKEKMLFTKILLKELAMESPKIIDLSLSDAYPGEIIVTLSSGSLLRLPIKTLDRALDLYKHMKKSPVIESEKQYVYDLRFPNFLLLKAL

SEQ ID NO: 911 - protein, 125 aa, Chlamydia pneumoniae
  CPn0909
IISLIFTRFLLERLLMNLSAKEYGDIIVIYLQGSLDAVSVPSVQEYLEQFIQKKHLKIALNFTDVSYISSAGIRLLLSNFKLVQSLGGKMCLCCVKESVTEVMRIAGLDQLILLCQSEQECLSKL

SEQ ID NO: 912 - protein, 345 aa, Chlamydia pneumoniae
  CPn0910
FLYMLPFEFEFNTTSSPECDVCLDPQKLFVKLFKRTIVLLSGPTGSGKTDVSLALAPMIDGEIVSVDSMQVYQGMDIGTAKVSLKARQEIPHHLIDIRHVQEPFNVVDFYYEAIQACQNILSRNKVPILVGGSGFYFHAFLSGPPKGPAADPQIREQLEAIAEEHGVSALYEDLLLKDPEYAQTITKNDKNKIIRGLEIIQLTGKKVSDHEWDIVPKASREYCCRAWFLSPETEFLKNNIQMRCEAMLQEGLLEEVRGLLNQGIRENPSAFKAIGYREWIEFLDNGEKLEEYEETKRKFVSNSWHYTKKQKTWFKRYSIFRELPTLGLSSDAIAQKIAKDYLLYS

SEQ ID NO: 913 - protein, 365 aa, Chlamydia pneumoniae
  CPn0911
SLLLAIFNVNYFMNLCKRISFEEGLELFVSSPIERLQERADAIRKERYPSNEVTYVLDANPNYTNICKIDCTFCAFYRKPKSPDAYLLSFDEVRSLLQRYVSSGVKTVLLQGGVHPGLGIDYLEELVRITVQEFPSIHPHFFSAVEIEHACRVSGISIEQGLQRLWDAGQRTIPGGGAEILSERVRKIISPKKMQPGGWINLHKLAHLMGFRTTATMMFGHVENPEDILIHLQTLRDAQDSCPGFYSFIPWSYKPGNTALRRNVPQQASIETYYRILALGRIFLDNFDHVAASWFGEGKSLGAKALHYGADDFGGVILDESVHKATGWSIQSSEEEICNIIRSEGFIPVERNTFYQHISCTVSSL

SEQ ID NO: 914 - protein, 547 aa, Chlamydia pneumoniae
  CPn0912
VVIMDNSDNSFHTLETEQGSFLNDELAVEEVASTESTEISDATLCFAEKKVAFILNKMREALTGSSQGSDLRLFWDLRKQCLPLFNEIEDTAKRADHWRCYIELTKEGRHLKGLQDEEGSFVVGQIDLAITCLEKDILKFQEGTEDKIFKDREDNFLESQALDKHQAFYKQHHTSLLWLSSFSSKIIDLRKELINVGMRMRLKSKFFQRLSNLGNQVFPKRKELIEKVSQTFAEDVDAFVAKYFIGSDKETLKKTVFFLRKEIKNLQHAAKRLFVSSHVFAETRLKLSKCWDQLKGMEKEIRQEQGRLRVVSAENSKEVRQMLAEVSSLLIEGNDLSKVRKDLEGISKKIRALDLTHDDVISLKKEMQQLFDQLREKQDAAEHSYQEQLAKDKQVKKEAARSLAERITTFSKTCSEGNITSESREEWQTLKELLGKMSFLPPPEKISLDNQLNLALQTIVNFFEEQLLSSPDSREKLVNMRQVLKQRRERRQELKDKLEQDKKLLGSSGLDFDRAMQYSALVEEDKRALEELDASILELKQQIQQLL

SEQ ID NO: 915 - protein, 79 aa, Chlamydia pneumoniae
  CPn0913
RIGCKYFRIEATDSAIAMRRNCIYAFDLDGTLLKGNSSWSFYCYGLLQGLFSYKTLPPCIYRFFRFKFFFGIFHPSIIR

SEQ ID NO: 916 - protein, 163 aa, Chlamydia pneumoniae
  CPn0914
VFFWDLPSFYYSIVTRLLSSVPCDDLYEVALNFVSTLTGSDFYAPVLEKLEEAFADTTGQVILFSSSPDFIVHPIAQQLGISSWYASCYRDQSAEQTIYKKCLTGDKKAQILSYIKKINQARSHTFSDHILDLPFLMLGEEKTVVRPQGRLKKMAKKYYWNIV

SEQ ID NO: 917 - protein, 139 aa, Chlamydia pneumoniae
  CPn0915
FHLKKSSTLSWIIEYPKAGFMDSFCFDLLKVAAKAIDDKKGNNLVVLDVRTISEFTDYFVFVEGSVNVHVKALANTIVEELKKQKVSPLHVEGITDGNWVVIDYGFIVVHVFVSEIRGKYRLEELWKDGFIVTSKLLAS

SEQ ID NO: 918 - protein, 424 aa, Chlamydia pneumoniae
  CPn0916
LLNGVRVYMSKKRVVVTGFGVVSCLGNEVDTFYDNLLAGVSGVRPITSFPCEDYATRFAGWIPEFNPEPYVDKKQARRVDPFITYAMVAAKKAIAMSRWDKDHLPSDPVRCGVIVGSGMGGLSTLDQGMERLLVIHKKLSPFFIPYIITNMAPALIAMDFGLMGPNYSISTACATGNYCIDAAYQHLVSGRADMIICGGTEAAVNRIGLEGFIANRALSERNDAPDQASRPWDRDRDGFVLGEGAGILVLETLESALRRDAPIFAEMLGSYVTCDAFHITAPRDDGEGITACVLGALNSAGIPKERVNYVNAHGTSTPLGDLSEVLAVKKAFGSHVRNLRMNSTKSLIGHCLGAAGGVEAVVAIQAILTGKLHPTINLDNPIAEIEDFDVVANKAQDWDIDVAMSNSFGFGGHNSTILFSRYVP

SEQ ID NO: 919 - protein, 162 aa, Chlamydia pneumoniae
  CPn0917
FNDIILEVCTLVMMKTKYEYSFGVIPIKFFGTPDKNTLKACFICHTRGKHWGFPKGHSEDKEGPQEAAERELVEETGLSVVNFFPKVLIEQYSFNNEEQVFVRKEVTYFLAEVRGDIHADPMEICDSQWLSLQEGLRLLSFPELRDLTVEADKFINNYLFSS

SEQ ID NO: 920 - protein, 218 aa, Chlamydia pneumoniae
  CPn0918
ELLMSKKPLYVAHPWHSPTLTQDNYESLCCYIEITPYDSVKFELDKATGLLKVDRPQKFSNFCPCLYGLLPQTYCGTASGNYSGEQTRREGIQGDKDPLDVCVLTEKNIHHGNILLQARPIGGLRIIDSGEADDKIIAVLEDDLVFAEIEDISDCPGTVLDMIQHYFLTYKATPNHLIKGSPAKIEIVGIYGKKEAQKVIQLAHEDYLSYIGDTAEVN

SEQ ID NO: 921 - protein, 352 aa, Chlamydia pneumoniae
  CPn0919
FMKYSLNFKEIKIDDYERVIEVTCSKVRLHAIIAIHQTAVGPALGGVRASLYSSFEDACTDALRLARGMTYKAIISNTGTGGGKSVIILPQDAPSLTEDMLRAFGQAVNALEGTYICAEDLGVSINDISIVAEETPYVCGIADVSGDPSIYTAHGGFLCIKETAKYLWGSSSLRGKKIAIQGIGSVGRRLLQSLFFEGAELYVADVLERAVQDAARLYGATIVPTEEIHALECDIFSPCARGNVIRKDNLADLNCKAIVGVANNQLEDSSAGMMLHERGILYGPDYLVNAGGLLNVAAAIEGRVYAPKEVLLKVEELPIVLSKLYNQSKTTGKDLVALSDSFVEDKLLAYTS

SEQ ID NO: 922 - protein, 331 aa, Chlamydia pneumoniae
  CPn0920
ILEENSMHSELPNYQNIVESVVTEITTQLLNYRSEHRLVPFWEKSDGSFITAADYGSQYYLKQQLAKAFPNIPFIGEETLYPDQDNEKIPEILKFTRLLTSSVSRDDLISTLVPPPSPTSLFWLVDPIDGTAGFIRHRAFAVAISLIYEYRPILSVMACPAYNQTFKLYSAAKGHGLSIVHSQNLDRRFVYADRKQTKQFCEASLAALNQQHHATRKLSLGLPNTPSPRRVESQYKYALVAEGAVDFFIRYPFIDSPARAWDHVPGAFLVEEAGGRVTDALGAPLEYRKESLVLNNHAVILASGDQETHETTLAALQNQLNVVPTDKLIAL

SEQ ID NO: 923 - protein, 256 aa, Chlamydia pneumoniae
  CPn0921
GELMLIKLWRATYEGMYTFLVGALLKLRYRMQVEGWDTLNINPKQGCLFLANHVAEVDPIILEYLFWSRFHVRPMAVEYLFHSRVVQWFLNSVRSIPIPQLVPGKESKRSLERMNVCYEEASRALNRGESLLLYPSGRLSRTGKEEIVNQYSAYVLLHRVMECNVVLVRVSGLWGSAFSRYKQNSTPKLGPAFKEAFRALLRRGIFFMPKRFVKITLCQVDHLFLKQFPTKQDLNTFLASWFNQGDDNLPIEVPYA

SEQ ID NO: 924 - protein, 554 aa, Chlamydia pneumoniae
  CPn0922
QFAHRSSLRITRKLRRMHDQRNRGHNNHNLRLRPGSTLLEAFLILCSEHEEGIACFDEHLGSLSYRELRNAIIAVAIKVSKFSEDRVGVMMPASIGAFIAYFGILLAGKTPVMMNWSQGLRELRACTKTVEVRRVLTSQQFIKHLTEVQGFVEYPFDLMYMEDVRKRLSWWEKCRIGLYSKCSVPWLLRIFGVSGVESDDTAVILFTSGTEKLPKAVPLTHKNLMENQEACLKFFDPNTQDVMLAFLPPFHAYGFNSCGLFPLLMGVHVVFASNPLNPKKLVEFIDDKKVTFFGSTPVFFDYILKTAKKQNSCLESLRLVVIGGDALKDTLYEETKKLQPQIALYQGYGATECSPVISITTKESPRKSECVGMPIEGMDVLIISKETHIPVSSGEQGLIVVRGNSVFSGYLGNHEHQSFVSLGGDQWYLTGDLGHIGPSGDLFLEGRLSRFVKIGGEMVSLEALESILHEHFTENQNEDAGSLVVCGIPGDKVRLCLFTTLATTIHEVNDILKSAETSSIVKISYVHQVESIPILGIGKPDYVSLNALAVSLFG

SEQ ID NO: 925 - protein, 376 aa, Chlamydia pneumoniae
  CPn0923
VCKESFLTTSDVIDFVTNDFLGFARSPTIYCEVSKRFQIHCQQFPHEKLGIRGSRLMVGPSSVIDDLESKIASYHGAPNAFIVNSGYMANLGLCHHVSRSTDVLLWDEEVHMSVVHSLSAISGQHHTFHHNNLEHLESLLQCYRISSKGRIFIFVSSVYSFRGTLAPLEQIIALSKKYHAHLIVDEAHAMGIFGDDGKGLCHALGYENFYAVLVTYGKALGTMGASLLTSSEVKYDLMQNSPPLRYSTSLSPHTLISIGTAYDFLASEGEIARKQVFKLKEHFHECFDSHAPGCVQPIFLPHTCLEEAISVLETTGIHVGVVAFAKHPFLRVNLHAYNTVDEVNLLAQVMKPYLEKSSHRVHINHEFHLWRELCQH

SEQ ID NO: 926 - protein, 758 aa, Chlamydia pneumoniae
  CPn0924
KRFTAKTKSMGYIESSTFRLYAEVIVGSNINKVLDYGVPENLEHITKGTAVTISLRGGKKVGVIYQIKTTTQCKKILPILGLSDSEIVLPQDLLDLLFWISQYYFAPLGKTLKLFLPAISSNVIQPKQHYRVVLKQSKAKTKEILAKLEVLHPSQGAVLKILLQHASPPGLSSLMETAKVSQSPIHSLEKLGILDIVDAAQLELQEDLLTFFPPAPKDLHPEQQSAIDKIFSSLKTSQFHTHLLFGITGSGKTEIYLRATSEALKQGKSTILLVPEIALTVQTVSLFKARFGKDVGVLHHKLSDSDKSRTWRQASEGSLRILIGPRSALFCPMKNLGLIIVDEEHDPAYKQTESPPCYHARDVAVMRGKLAHATVVLGSATPSLESYTNALSGKYVLSRLSSRAAAAHPAKISLINMNLEREKSKTKILFSQPVLKKIAERLEVGEQVLIFFNRRGYHTNVSCTVCKHTLKCPHCDMVLTFHKYANVLLCHLCNSSPKDLPQSCPKCLGTMTLQYRGSGTEKIEKILQQIFPQIRTIRIDSDTTKFKGSHETLLRQFATGKADVLIGTQMIAKGMNFSAVTLAVILNGDSGLYIPDFRASEQVFQLITQVAGRSGRSHLPGEILIQSFLPDHPTIHSAMRQDYSAFYSQEITGRELCEYPPFIRLIRCIFMGKCPKQTWEEAHRVHNILKEQLESTNPLMPVTPCGHFKIKDTFRYQFLIKSAYVIPVNKKLHHALMLAKLSPKVKFMIDVDPMTTFF

SEQ ID NO: 927 - protein, 230 aa, Chlamydia pneumoniae
  CPn0925
KHWLFMENSQNFHDTLCQLLDRYSEELYPTLASLLNVTLPNTAISASVSSIPEKAVEVPNAEPQPITPPPPTNLSQEKTKPSDWKCVPLHPDLSQNAILKEKYPALKDCSLPAPKIPCSIFVYEENNEEVLFFNRLAKILTQQLFPTKLTLIHAKTNIFVNNPNFFLALAPLNVIRYKIPTTDYHQSLTQNGCIFLPLYSSLEYEKDSQLKRNLWAILNRLPFAYTPKSS

SEQ ID NO: 928 - protein, 183 aa, Chlamydia pneumoniae
  CPn0926
CHHTQQTYSTRFFKDSDMKFWLQGCAFVGCLLLTLPCCAARRRASGENLQQTRPIAAANLQWESYAEALEHSKQDHKPICLFFTGSDWCMWCIKMQDQILQSSEFKHFAGVHLHMVEVDFPQKNHQPEEQRQKNQELKAQYKVTGFPELVFIDAEGKQLARMGFEPGGGAAYVSKVKSALKLR

SEQ ID NO: 929 - protein, 383 aa, Chlamydia pneumoniae
  CPn0927
DSCMIPSPTPINFRDDTILETDPKPSLIMFSSKKTEIASERRKAHPTLFKVLGTIWNIVKFIISIILFLPLALLWVLKKTCQFFILPSSIISQSMSKTAVAIRRMTFLSHIKQLLSLKEISAADRVVIQYDDLVVDSLAIKIPHALPHRWILYSQGNSGLMENLFDRGDSSLHQLAKATGSNLLVFNYPGIMSSKGEAKRENLVKSYQACVRYLRDEETGPKANQIIAFGYSLGTSVQAAALDREVTDGSDGTSWIVVKDRGPRSLADVANQICKPIASAIIKLVGWNIDSVKPSERLRCPEIFIYNSNHDQELISDGLFERENCVATPFLELPEVKTSGTKIPIPERDLLHLNPLSPNVVDRLAAVISNYLDSENRKSQQPD

SEQ ID NO: 930 - protein, 384 aa, Chlamydia pneumoniae
  CPn0928
RRKDFAFTLLNLSNRSDILSGIFSNPHPVSYFSSTHAKQLSDFSKKHPILTKIVTIIVKIFKLLIGLIIPPLGIYWLCQLVCSLALFPRSSMLYSVLKTCFKKYRLEQEIQDYFVKNLDPSFKDPAVSESKRITIQQDHLTIDTLAIHFSTARPKRWLLISLGSGDFLEDMIGLKDSLFLSWKELAKLLGANILIYNYPGVKSSTGKLNLENLATAHNLCAKYLQDKIQGPGANEIITYGYSLGGVVQSAALQKNPFTNSETSWVAVKDRAPHSLPAAANSFFGPIGKLIAVLARWKMDAEKNSRELPCPEILVYSADRFRPSEVGDDTALLPEFTLAHAIKRTPFARSKKFIGEVNLLHSSPLKHPTIQKLAEAILESLSRKN

SEQ ID NO: 931 - protein, 372 aa, Chlamydia pneumoniae
  CPn0929
EKFMAPIHGSNAFVEDILHSHPSPQATYFSSTRAQKLHEFKDRHPVLTRIASVIIKIFKVLIGLIILPLGIYWLCQTLCTNSILPSKNLLKIFKKQPNTKTLKTNYLHALQDYSSKNRVASMRRVPILQDNVLIDTLEICLSQAPTNRWMLISLGSDCSLEEIACKEIFDSWQRFAKLIGANILVYNYPGVMSSTGSSSLKDLASAHNICTRYLKDKEQGPGAKEIITYGYSLGGLIQAEALRDQKIVANDDTTWIAVKDRCPLFISPEGFHSCRRIGKLVARLFGWGTKAVERSQDLPCLEIFLYPTDSLRRSTVRQNKLLAPELTLAHAIKNSPYVQNKEFIEVRLSSDIDPIDSKTRVALATPILKKLS

SEQ ID NO: 932 - protein, 160 aa, Chlamydia pneumoniae
  CPn0930
NKMSELAPCSTGLQMVPHTQVHHALDTRRVILTIAACLSLIAGIVLVGLGAAAILPSLFGVIGGMILILFSSIALIYLYKKTREVDQIALEPLPEMISKDQSIIDFVKTRDYASLEKKATFAYTHTHYYDGSMVFYREIPRFMLGSYLALRKDMDRQALF

SEQ ID NO: 933 - protein, 547 aa, Chlamydia pneumoniae
  CPn0931
IDFRVLGWKSDIYTNILEERMTARAEYLDHEDFLYRSHKLQELSELGVVLYPYEFPGVFSCEDIKKTFASQELGNSEAAMSRSTPRVRFAGRLVLFRAMGKNAFGQILDHNQTIQVMFNREFTSVHGLSEDAEITPIKFIEKKLDLGDILGIDGYLFFTHSGELTVLVETVTLLCKSLLSLPDKHAGLSDKEVRYRKRWLDLISSREVSDTFVKRSYIIKLIRNYMDAHGFLEVETPILQNIYGGAEAKPFTTTMEALHSEMFLRISLEIALKKILVGGAPRIYELGKVFRNEGIDRTHNPEFTMIEAYAAYMDYKEVMVFVENLVEHLVRAVNHDNTSLVYSYWKHGPQEVDFKAPWIRMTMKESIATYAGIDVDVHSDQKLKEILKKKTTFPETAFATASRGMLIAALFDELVSDNLIAPHHITDHPVETTPLCKTLRSGDTAFVERFESFCLGKELCNAYSELNDPIRQRELLEQQHTKKELLPDSECHPIDEEFLEALCQGMPPAGGFGIGVDRLVMILTNAASIRDVLYFPVMRRFDAEKTN

SEQ ID NO: 934 - protein, 480 aa, Chlamydia pneumoniae
  CPn0932
VKSDTVMAFSHIEGLYFYNTASQKKELFFPNHTPVRLYTCGPTVYDYAHIGNFRTYVFEDILKRTLVFFGYSVTHVMNITDVEDKTIAGASKKNIPLQEYTQPYTEAFFEDLDTLNIARADFYPHATHYIPQMIQAITKLLEQGIAYIGQDASVYFSLNRFPNYGKLSHLDLSSLRCCSRISADEYDKENPSDFVLWKAYNPERDGVIYWESPFGKGRPGWHLECSIMAMELLGDSLDIHAGGVDNIFPHHENEIAQSEALSGKPFARYWLHSEHLLIDGKKMSKSLGNFLTLRDLLHQEFTGQEVRYMLLQSHYRTQLNFTEEALLACRHALRRLKDFVSRLEGVDLPGESPLPRTLDSSSQFIEAFSRALANDLNVSTGFASLFDFVHEINTLIDQGHFSKADSLYILDTLKKVDTVLGVLPLTTSVCIPETVMQLVAEREEARKTKNWAMADTLRDEILAAGFLVEDSKSGPKVKPL

SEQ ID NO: 935 - protein, 349 aa, Chlamydia pneumoniae
  CPn0933
PVILLQNIKRCSLKQLKVLATLLLSLSLPTLEAAENRDSDSIVWHLDYQEALQKSKEAELPLLVIFSGSDWNGPCMKIRKEVLESPEFIKRVQGKFVCVEVEYLKHRPQVENIRQQNLALKSKFKINELPCMILLSHEEREIYRIGSFGNETGSNLGDSLCHIVESDSLLRRAFPMMTSLSLSELQRYYRLAEELSHKEFLKHALELGVRSDDYFFLSEKFRLLVEVGKMDSEECQRIKKRLLNKDPKNEKQTHFTVALIEFQELAKRSRAGVRQDASQVIAPLESYISQFGQQDKDNLWRVEMMIAQFYLDSDQWHHALQHAEVAFEAAPNEVRSHISRSLEYIRHQS

SEQ ID NO: 936 - protein, 141 aa, Chlamydia pneumoniae
  CPn0934
YFVHPLTLPKQSRVLKRKQFLYITRSGFCCRGSQATFYVVPSRHPGTCRMGITVSKKFGKAHERNSFKRVVREVFRHVRHQLPNCQIVVFPKGHKQRPVFSKLLQDFINQIPEGLHRLGKTKATTGGECTPKSEKCVTAPR

SEQ ID NO: 937 - protein, 48 aa, Chlamydia pneumoniae
  CPn0935
EDTVKRTYQPSKRKRRNSVGFRTRMATRNGRKLLNRRRRHGRHSLVDL

SEQ ID NO: 938 - protein, 47 aa, Chlamydia pneumoniae
  CPn0936
YLMKVSSSVKADPSKGDKLVRRKGRLYVINKKDPNRKQRQAGPARKK

SEQ ID NO: 939 - protein, 104 aa, Chlamydia pneumoniae
  CPn0937
VKRMAKKSSVAREAKRRRLVEANFKKRSDLRKIVKSLSVSEEEKENARISLNKMKRDTSPTRLHNRCLLTGRPRGYLRKFAISRICFRQMASMGEIPGVIKASW

SEQ ID NO: 940 - protein, 169 aa, Chlamydia pneumoniae
  CPn0938
QTINLSGTLRTMLPISILLFYVILGCLSAYIADKKKRNVIGWFFAGAFFGFIGLVVLLLLPSRRNALEKPQNDPFDNSDLFDDLKKSLAGNDEIPSSGDLQEIVIDTEKWFYLNKDRENVGPISFEELVVLLKGKTYPEEIWVWKKGMKDWQRVKDVPSLQQALKEASK

SEQ ID NO: 941 - protein, 189 aa, Chlamydia pneumoniae
  CPn0939
HINRWTIRLSLTLIISTVLYFFSEEIELIGGGKMEKQNLKLDVKEIEFPETVFSRDIETRVIQVIILHCLAKINGVSLLGGNLIDALFGRDIERMKGIYVEQDSKNHLVKVRVEVNVDYGVSIPEKTEEIQGCIVSEISEYTGLHVAAVHVIIKGLTQPKDRIDEEIEEEVSVQDLPSPEDFLLENSEG

SEQ ID NO: 942 - protein, 612 aa, Chlamydia pneumoniae
  CPn0940
DATTDIILVMRIEDFSLKLIPSSPGVYLMKDVHDQVLYIGKAKNLKNRLASYFHEKGDSRERIPFLMKKTASIETIVVSNETEALLLENNLIKQHHPKYNVLLKDDKTFFCLAISLSHSWPKVEAIRTKAITSSQRQLIFGPYVSAEACHTLLEVISQWFPLRTCSDREFALRKRPCILYDMKRCLAPCVGYCTPEEYQGTLDKAILFLKGKIEEVVKDLEKVIQKASDNLEFEQAANYYRTLSLIKQAMAKQQVEKFHFQNIDALGLYRHKQRTILTLLTVRSGKLLGARHFSFFENAQEDQDLLSSFILQYYVSQPYIPKEILTPLPLEFPTLSYVLNAESPPRLRSPKTGYGKELLDLAYRNAKAYAATTLPSSTLPYQDFQNILRMSQYPYRIECYDNAHMQGAHATGVYIVFENNGFDPKQYRTFSIDSEKTQNDLALLEEVLLRRFHSLTTALPDMIVVDGGKTHYNKTKKIIQTLNLTGIQVVTIAKEKSNHSRGLNKEKIFCETFPEGFSLPPTSNLLQFFQILRDEAHRFAISKHRKKRGKALFEQEKIPGIGEVKRKRLLQKFKSWKQVMLSSQEELEAIPGLTKKDIAVLLARQKDFNKSD

SEQ ID NO: 943 - protein, 829 aa, Chlamydia pneumoniae
  CPn0941
VMTEKKPTPMMEQWHQCKEKAGDSVLLFRMGDFYEAFYDDAVLLSQHLELTLTQRQGIPMSGIPVSTVDTYVDRLIGKGFKVAVAEQFGEPAKEKESKKIGPMARDIQRFVTPGTLLSSTLLQEKFNNYIVAINRIGSLFGFACLDLSTGSFFIEECENTKELVDEICRLAPSEVLSCNKFYNKETAIVMQLQQHLKLTLSTYADWAFEHKFASQKLTTHFQVASLDGFGLKGLVPAINAAGGLLSYIQDKLLLPTKHIAIPQTRGKQQKLLIDTASQVNLELLAPLNDPQGKNSLLRIMDHTSTPMGGRLLRQILISPFYNPKEILVRQDAVEFFLRQVTLRKNIKTYLCQVRDIERLMTKVTTGLAGPRDIGTLRDSFSAGAQIYEQLASATLPEFFIDKCSLDTKLASLIALLSKSLNGDLPLRVSDGNIFVDEFHNDLKRLRHNQEHSQEWIWEYQERIRKETGIKKLKICFAQALGYYIEVSSEFAPQLPKDFIRRQSRLHAERFTTIELQQFQDDMSNISEKLQTLETQFFKDLCSHILQLRTEILALSQSLADLDYIISLADLAHAQGYCRPHVDMSDTLCIYRGCHPVAKTLVDTGKFIPNDTEMRGSQTRMILLTGPNMAGKSTYIRQIALLVIMAQMGSYIPAKSAHIGVIDKIFTRIGAGDNLSKGMSTFMVEMAETANILHNATDRSLVILDEVGRGTSTYDGLAIAQAVVEYLLFTDKKKAKTLFATHYKELTTLEDHCPHVENFHAGVKDKAGQPVFLYEILKGHSQKSFGIHVARLAGFPLCVVSRAQQILRQLEGPESITRPAQDKMQQLTLF

SEQ ID NO: 944 - protein, 600 aa, Chlamydia pneumoniae
  CPn0942
NCSITKLRTAMYTEESLDNLRHSIDIVDVLSEHIHLKRSGATYKACCPFHTEKTPSFIVNPAGAHYHCFGCGAHGDAIGFLMQHLGYSFTEAILVLSKKFQVDLVLQPKDSGYTPPQGLKEELRHINSEAETFFRYCLYHLPEARHALQYLYHRGFSPDTIDRFHLGYGPEQSLFLQAMEERKISQEQLHTAGFFGNKWFLFARRIIFPVHDALGHTIGFSARKFLENSQGGKYVNTPETPIFKKSRILFGLNFSRRRIAKEKKVILVEGQADCLQMIDSGFNCTVAAQGTAFTEEHVKELSKLGVLKVFLLFDSDEAGNKAALRVGDLCQTAQMSVFVCKLPQGHDPDSFLMQRGSSGLIALLEQSQDYLTFLISEKMSSYPKFGPREKALLVEEAIRQIKHWGSPILVYEHLKQLASLMMVPEDMVLSLANPQVTAEPQNIPIKQKVPKIHPHIVMETDILRCMLFCGSNTKILYTAQFYFVPEDFKHPECRKLFAFMISYYEKYRKNVPFDEACQVLSDSQILQLLTKRRLNTEALDTIFVQSLQKMADRRWREQCKPLSLNQNIQDKKLEILEDYVQLRKDRTIITLLDPESELIP

SEQ ID NO: 945 - protein, 89 aa, Chlamydia pneumoniae
  CPn0943
FFMKSFKFLLPFLSVILCCGNLLSSPRSRAISVTESIGMSAVKTLVLSEKAHEFLEGIGYGVGASSILRDWQTQQWLEIESLLAQNEVM

SEQ ID NO: 946 - protein, 165 aa, Chlamydia pneumoniae
  CPn0944
IKIMMHRYFIPLLALLIFSPSLVRAELQPSENRKGGWPTQLSCAEGSQLFCKFEAAYNNAIEEGKPGILVFFSERPTPEFADLTNGSFSLSTPIAKGFNVVVLCPGLISPLDFFHKMDPVILYMGSFLEMFPEVEAVSGPRLCYILIDEQGGAQCQAVLPLETKN

SEQ ID NO: 947 - protein, 220 aa, Chlamydia pneumoniae
  CPn0945
SIFKNKILPSYFGHNFDQLRRHYMRIALSLLSLLMIFPIFGEESRPGSEDGNSNTQEIVGSQDTQVCLYHSYEQGLQASRIEGKPLVIVVLCNSGDDGQACTIGLSETCEEVLSVLSGSIFSELANFVVLVPSGVNPLIYPPIEDPILAEIVKFKELFKDESFPTGLSIIVVGVTPEGPGDIIEVSPVSLTVEEEETLPSEQTTEVESTSELQSEDPAIA

SEQ ID NO: 948 - protein, 1024 aa, Chlamydia pneumoniae
  CPn0946
GECQKKKCYTLESFVSEHPLTLQSMIATILRFWSEQGCVIHQGYDLEVGAGTFNPATFLRALGPEPYKAAYVEPSRRPQDGRYGVHPNRLQNYHQLQVILKPVPENFLSLYTESLRAIGLDLRDHDIRFIHDDWENPTIGAWGLGWEVWLNGMEITQLTYFQAIGSKPLDTISGEITYGIERIAMYLQKKISIYDVLWNDTLTYGQITQASEKAWSEYNFDYANTEMWFKHFEDFAEEALRTLKNGLSVPAYDFVIKASHAFNILDARGTISVTERTRYIARIRQLTRLVADSYVEWRASLNYPLLSLSSTSEPKETSESVVPMISSTEDLLLEIGSEELPATFVPIGIQQLESLARQVLTDHNIVYEGLEVLGSPRRLALLVKNVAPEVVQKAFEKKGPMLTSLFSPDGDVSPQGQQFFASQGVDISHYQDLSRHASLAIRTVNGSEYLFLLHPEIRLRTADILMQELPLLIQRMKFPKKMVWDNSGVEYARPIRWLVALYGEHILPITLGTIIASRNSFGHRQLDPRKISISSPQDYVETLRQACVVVSQKERRMIIEQGLRAHSSDTISAIPLPRLIEEATFLSEHPFVSCGQFSEQFCALPKELLIAEMVNHQKYFPTHETSSGAISNFFIVVCDNSPNDTIIEGNEKALTPRLTDGEFLFKQDLQTPLTTFIEKLKSVTYFEALGSLYDKVERLKAHQRVFSTFSSLAASEDLDIAIQYCKADLVSAVVNEFPELQGIMGEYYLKHANLPTASAVAVGEHLRHITMGQKLSTIGTLLSLLDRLDNLLACFILGLKPTSSHDPYALRRQSLEVLTLVSASRLPIDLASLLDRLADHFPSTIEEKVWDKSKTIHEILEFIWGRLKTFMGSLEFRKDEIAAVLIDSATKNPIEILDTAEALQLLKEEHTEKLAVITTTHNRLKKILSSLKLSMTSSPIEVLGDRESNFKQVLDAFPGFPKETSAHAFLEYFLSLADLSNDIQDFLNTVHIANDDGAIRNLRISLLLTAMDKFSLCHWESVAV

SEQ ID NO: 949 - protein, 209 aa, Chlamydia pneumoniae
  CPn0947
GSRVGLPNYITFSRLFITPIFMILYLKGKWFGITPVVLPYVLLALLAISELTDAIDGYVARKFSQVTDLGKLLDPMADSIYRISIYLTFTQPPVNLPLLLVFIFLARDSVISTLRTVCAFRGRVVAARASGKLKAILQGVSFFLILLVMIPHSLGLLSQNGLEIFASVTVSIIAVYSIASGIEYFWMNKNFLSQRAKTKDSEKNHESKD

SEQ ID NO: 950 - protein, 479 aa, Chlamydia pneumoniae
  CPn0948
GESMRIVQVAVEFTPIVKVGGLGDAVASLSKELAKQNDVEVLLPHYPLISKFSSSQVLSERSFYYEFLGKQQASAISYSYEGLTLTIITLDSQIELFSTTSVYSENNVVRFSAFAAAAAAYLQEADPADIVHLHDWHVGLLAGLLKNPLNPVHSKIVFTIHNFGYRGYCSTQLLAASQIDDFHLSHYQLFRDPQTSVLMKGALYCSDYITTVSLTYVQEIINDYSDYELHDAILARNSVFSGIINGIDEDVWNPKTDPALAVQYDASLLSEPDVLFTKKEENRAVLYEKLGISSDYFPLICVISRIVEEKGPEFMKEIILHAMEHSYAFILIGTSQNEVLLNEFRNLQDCLASSPNIRLILDFNDPLARLTYAAADMICIPSHREACGLTQLIAMRYGTVPLVRKTGGLADTVIPGVNGFTFFDTNNFNEFRAMLSNAVTTYRQEPDVWLNLIESGMLRASGLDAMAKHYVNLYQSLLS

SEQ ID NO: 951 - protein, 199 aa, Chlamydia pneumoniae
  CPn0949
RTALLAQDYGENNIMELVVTSRETGKKSFLKKIRQQGGIPAVVYSAGKSLANITVDALVFKKFLSNLESGALSSTVFSLSYEGRIIKALVKDIQYQITTYDVIHLDFEELVEDRPIKLNIPIRCINAVDCIGVKLGGSLRQVIRAVRVVCKPKDIVPFLELDVRSVGLSQTRKLSDIKIPAGIETITPLKEVAITVSRR

SEQ ID NO: 952 - protein, 186 aa, Chlamydia pneumoniae
  CPn0950
PSLEDNMAKLIVAIGNPRHGYANTRHNAGFLLADRLVEELQGPPFKPLSKCHALMTLVESSSGPLVFIKPTTFVNLSGKAVVLAKKYFNVALSHILVLADDVNRSFGKLRLCFNGGSGGHNGLKSITASLGSNEYWQLRFGVGRPLEEGVELSNFVLGKFSEEENLQLGSIFVEASTLFTEWCSKF

SEQ ID NO: 953 - protein, 115 aa, Chlamydia pneumoniae
  CPn0951
EFLMGKKENQLYEGAYVFSVTLSEEARRKALDKVISGITNYGGEIHKIHDQGRKKLAYTIRGAREGYYYFIYFSVSPGAITELWKEYHLNEDLLRFMTLRADSVKEVLEFASLPE

SEQ ID NO: 954 - protein, 85 aa, Chlamydia pneumoniae
  CPn0952
GENMNKPVHNNEHRRKRFNKKCPFVSAGWKTIDYKDVETLKKFITERGKVLPRRITGVSSRFQGVLSQAIKRARHLGLLPFVGED

SEQ ID NO: 955 - protein, 174 aa, Chlamydia pneumoniae
  CPn0953
FKGRRMKQQLLLLEDVDGLGRSGDLITARPGYVRNYLIPKKKAVIAGAGTLRLQAKLKEQRLIQAAADKADSERIAQALKDIVLEFQVRVDPDNNMYGSVTIADIIAEAAKKNIFLVRKNFPHAHYAIKNLGKKNIPLKLKEEVTATLLVEVTSDNEYVTVLAQGKQTEENQEG

SEQ ID NO: 956 - protein, 150 aa, Chlamydia pneumoniae
  CPn0954
GRKVCYKDIMQYFSPAKLNLFLKIWGKRFDNFHELTTLYQAIDFGDTLSLKNSMKDSLSSNVNELLSPSNLIWKSLEIFRRETQIHQPVSWHLNKSIPLQSGLGGGSSNAATALYALNEHFQTHIPITTLQLWAREIGSDVPFFFLQEQH

SEQ ID NO: 957 - protein, 188 aa, Chlamydia pneumoniae
  CPn0955
RAFPNPYSYNNIATLGSRNRKRCSFFFSSGTALGKGRGEHLFSIKKLNHKHKYVLYLDHQGIPTEKAYQSLLPQDYSTGNHNACFYGENDLEKSVFRIRTDLKNKKHMLERMWSPFESHVLMSGSGATLFVCYLEELEQDSKVSSQIHSLIKQTQGIPVSRLYREPHWYSLKQSTYKNSPLECFQPQI

SEQ ID NO: 958 - protein, 455 aa, Chlamydia pneumoniae
  CPn0956
LVWFSMILPPYSYSLKIGAAVLFFCSILHTFLTPWLYTLCQSYEHKKLVFPECWKRYARLSELFRILSRVEIVFFLWAVPLFFWFLYTEGYRISMAYFNSRNYGFAVFIMVILILLESRPIVYFAELVLSSIAKLGKTSPKSWWWTLMIAPPLLSCLLKETGAMIIGATLLMRHFYVFSPSRRFAYATMGLLFSNISIGGLTSYVSSRALFLIFPALKWEHSFFLSHFAWKAIVAILISTTIYYFIFRKEFKKFPDIPSDKDPSVEKVPWWIICVNIIFVGSIILSRSTPLFMGALLLFYLGFQKFTIFYQDPINLSKVCYVGLFYAGLVVFGDLQEWWVLNLMQGLSDFGYMTVSYTLSIFLDNALVNYLVHNLSVATDCYHYLVVAGCMAAGGLTLVSNIPNIVGYLILRSAFPSSTIHMGWLFLGALGPSIISLGVFWLLKNVPEFLYCFFR

SEQ ID NO: 959 - protein, 950 aa, Chlamydia pneumoniae
  CPn0957
KIYTRNCKMFWKLLCPILICTSLSITSCEQQFKVVPNQCPLQVSTPAAADQKIEKIICSNGLPLLIISDPNLPTSGAALLVKTGNNADPEEYPGMAHFTEHCVFLGNEKYPEVSGFPGFLSENNGVHNAFTYPNKTVFVFSVEHSAFSDALDQFVHLFINPKFRQEDLDREKYAVHQEFAAHPLSDGRRVHRIQQLVAPQGHPCARFGCGNASTLTPVTTEKMAEWFKLHYSPENMCAIAYTSAPLSKAKKQFSKIFSQIPRSKNYERQEPFLPSGDTSSLKNLYINQAIQPTSNLEIYWHIYESSHPIPLGCYKALAEVLRNESKNSLVSLLKNEQLITDLDVEFFRSSLNTGEFYISYELTEKGDKHYSQVIDSTFQYLRYIQEHGIPNYTLEEISTINALNYCYSSKSPLFDLLCKQIVSLGNEDLSTYPYHSLVYPKYSSEDESALLNLVSDPEQARFVLSSKNSEHWEEATQLHDPIFDMTYYVKALDGVQDYGKVQSLKPIALPKPNLFIPKEVTLPGVHLLKKQEFPFAPALSYQDDKLTLYHCEDHYYTAPKLSSQIRIRSPQISRSSPQFLVATELYCLAVNDQLLREYYPATQAGLSFTSALGGDGIDLRVSGYTTTVPALLNSILTSLPNLEISYETFLVYKKQLLELYQGALLNCPVRSGLDELASQVMKETYSNTTKLSALEKLSFSEFQAFASNLFNSVHLEVMVLGNLSEQQKKDYLEMLQVFTASRSSHATKPFYYELQSQEISEIHHDYPLTANGMLLLLQDKSSPSIQGKVCAEMLFEWLHHITFEELRTQQQLGYMVGARYREFASRPFGFLYIRSDAYSPEELLAKTSLFLNKVSASPEKFGISQEKFANIRKAYINKILEPEHSLDMMNSALFSLAFERPFVEFSTPDLKIAIAETLTYEEFLKYCQCFLSNELGTQTSVYIRGTQKTS

SEQ ID NO: 960 - protein, 337 aa, Chlamydia pneumoniae
  CPn0958
IYRAIYMQFSRYLRYAFDNQYLPEPLYQKFSVFHQNYIDAATKKAAADQAEVLCLQWVKVIIEDLKNPFIFPPYHKKIRAPIDLFRLSIDFFSLVIDDKNSRILNLHRLKEIEEYIARGDNVVLLANHQTECDPQLMYYALGKTHPELMENMIFVAGDRVTSDPLARPFSMGCDLLCIYSKRHIATPPELREEKLLHNQKSMQILKTLLNEGGKFIYVAPAGGRDRKNAEGRLYPSEFSPESIEVFRLLAKASNQTTHFYPFALKTYDILPPPPKIENAIGEQRAIFFAPVFFNFGAELFFDALCSKEELIHCDKHAQRTLRAEKVFSIVKNLYEEL

SEQ ID NO: 961 - protein, 526 aa, Chlamydia pneumoniae
  CPn0959
AQGYGIGTRKVMENEILLNIESKEIRYAHLKNGQLFDLTIERKKVRQLKGNIYRGRVTNILRNIQSAFINIDERENGFIHISDILENSKKFEQMFDMDVDALPEEASEAPLLSSEEAPIEEFLKLDSPVLVQVVKEPIGSKGARLTSNISIPGRYLVLLPNSPHRGVSRKIEDPHMREQLKQLIRSFEMPQDMGLICRTASTTASTEALINEAHDLLLTWKTILEKFYSTEQPCLLYSETDILKKAVITCIDKNYKRLLIDDYATYQKCKHMLKKYSPDASIKIEYYRDSIPMFERFNIEKEIDKATRRKIWLSSGGYLFFDKTEAMHTIDVNSGRSTQLESGVEETLVQINLEAAEEIARQLRLRNVGGLVIIDFIDMKSRKNQRRVLERLKEHMKYDAARCTILSMSEFGLVEMTRQRNRESLMQTLFTLCPYCSGNAIIKTPESVVIEIERDLKKVINHKEHSHLCLVVHPEIASYMKQENDDNEMINLAKQLKAKLQINTSDSVHLNHYQFFSLITGESIDL

SEQ ID NO: 962 - protein, 176 aa, Chlamydia pneumoniae
  CPn0960
SLSLVSYLSNPQKALVLGSKGFSMDCVDNLKLYIFRLKLPGDTERISYSISPEYIREKGEEELLNSPIEVEGSLGRIDSDQWILSLSLKTQLGLCCPVCNNFFSHSVCLPDLQRVISHDEVGSGVFDCRPLIRQELLLESDCFEECSGQGCPERKNILKFLEDRKKHEGNSPFEYL

SEQ ID NO: 963 - protein, 64 aa, Chlamydia pneumoniae
  CPn0961
KVRNMAVPRNRHSNARKNIRRSHDAKKACHAAKCSNCKHALLPHTICPSCGFYNGKAVMTVEKK

SEQ ID NO: 964 - protein, 325 aa, Chlamydia pneumoniae
  CPn0962
ILSDFMEVQIGIDLMGGDHSPLVVWQVLVDVLKSQSSTIPFAFTLFASEEIRKQIQEEFISDLPQEKFPKIISAENFVAMEDSPLAAIRKKSSSMALGLDYLQEDKLDAFISTGNTGALVTLARAKIPLFPAVSRPALLVCVPTMRGHAVILDVGANISVKPEEMVGFARMGLAYRQCLGDSKIPTIGLLNIGSEERKGTEAHRQTFRMLRETFGEAFLGNIESGAVFDGAADIVVTDGFTGNIFLKTAEGVFEFLQRILGDKLEADIQRRLDYTFYPGSVVCGLSKLVIKCHGKACGSSLFHGILGSINLAQARLCKRILSNLI

SEQ ID NO: 965 - protein, 1617 aa, Chlamydia pneumoniae
  CPn0963
TPLRFKVAMVAKKTVRSYRSSFSHSVIVAILSAGIAFEAHSLHSSELDLGVFNKQFEEHSAHVEEAQTSVLKGSDPVNPSQKESEKVLYTQVPLTQGSSGESLDLADANFLEHFQHLFEETTVFGIDQKLVWSDLDTRNFSQPTQEPDTSNAVSEKISSDTKENRKDLETEDPSKKSGLKEVSSDLPKSPETAVAAISEDLEISENISARDPLQGLAFFYKNTSSQSISEKDSSFQGIIFSGSGANSGLGFENLKAPKSGAAVYSDRDIVFENLVKGLSFISCESLEDGSAAGVNIVVTHCGDVTLTDCATGLDLEALRLVKDFSRGGAVFTARNHEVQNNLAGGILSVVGNKGAIVVEKNSAEKSNGGAFACGSFVYSNNENTALWKENQALSGGAISSASDIDIQGNCSAIEFSGNQSLIALGEHIGLTDFVGGGALAAQGTLTLRNNAVVQCVKNTSKTHGGAILAGTVDLNETISEVAFKQNTAALTGGALSANDKVIIANNFGEILFEQNEVRNHGGAIYCGCRSNPKLEQKDSGENINIIGNSGAITFLKNKASVLEVMTQAEDYAGGGALWGHNVLLDSNSGNIQFIGNIGGSTFWIGEYVGGGAILSTDRVTISNNSGDVVFKGNKGQCLAQKYVAPQETAPVESDASSTNKDEKSLNACSHGDHYPPKTVEEEVPPSLLEEHPVVSSTDIRGGGAILAQHIFITDNTGNLRFSGNLGGGEESSTVGDLAIVGGGALLSTNEVNVCSNQNVVFSDNVTSNGCDSGGAILAKKVDISANHSVEFVSNGSGKFGGAVCALNESVNITDNGSAVSFSKNRTRLGGAGVAAPQGSVTICGNQGNIAFKENFVFGSENQRSGGGAIIANSSVNIQDNAGDILFVSNSTGSYGGAIFVGSLVASEGSNPRTLTITGNSGDILFAKNSTQTAASLSEKDSFGGGAIYTQNLKIVKNAGNVSFYGNRAPSGAGVQIADGGTVCLEAFGGDILFEGNINFDGSFNAIHLCGNDSKIVELSAVQDKNIIFQDAITYEENTIRGLPDKDVSPLSAPSLIFNSKPQDDSAQHHEGTIRFSRGVSKIPQIAAIQEGTLALSQNAELWLAGLKQETGSSIVLSAGSILRIFDSQVDSSAPLPTENKEETLVSAGVQINMSSPTPNKDKAVDTPVLADIISITVDLSSFVPEQDGTLPLPPEIIIPKGTKLHSNAIDLKIIDPTNVGYENHALLSSHKDIPLISLKTAEGMTGTPTADASLSNIKIDVSLPSITPATYGHTGVWSESKMEDGRLVVGWQPTGYKLNPEKQGALVLNNLWSHYTDLRALKQEIFAHHTIAQRMELDFSTNVWGSGLGVVEDCQNIGEFDGFKHHLTGYALGLDTQLVEDFLIGGCFSQFFGKTESQSYKAKNDVKSYMGAAYAGILAGPWLIKGAFVYGNINNDLTTDYGTLGISTGSWIGKGFIAGTSIDYRYIVNPRRFISAIVSTVVPFVEAEYVRIDLPEISEQGKEVRTFQKTRFENVAIPFGFALEHAYSRGSRAEVNSVQLAYVFDVYRKGPVSLITLKDAAYSWKSYGVDIPCKAWKARLSNNTEWNSYLSTYLAFNYEWREDLIAYDFNGGIRIIF

SEQ ID NO: 966 - protein, 504 aa, Chlamydia pneumoniae
  CPn0964
QSILESIIKYFYLIHNSKMHMSNPISLFSPAELIAKYNLIPKTSPIYPRRTELIILEENACQTRLTNVAQVLHPSSLFSMSKKILNPCGCSGGPLCWVILNILAFIITSVLFIILLPVNLIVAGLRLFMPLPPKKIVEDLSEPTTEETNEVIQPFIFALQALLFEDNKLRSFKIVEQSVGKAPLPNPFLNRLVAISPQESQEAMRKIPDLCSQLKKVLKSLGVLTPEWKHMLKYFEGLKNEHDSNPDKKTFPILIKLLIEALTGKSSLPKTPSTKEKMQAALFIASSCKTCKPTWGEVITRSLNRLYSIANEGDNQLLIWVQEFKERELMSIQDGDDAEEYRFAAQQHGERYTEAIEQVLRNESAAKLQWHVINTMKFFHGKNLGLVTEHLQDTLGALTLRQTTVDTHQGREDADLSAALFLNKYLNSGNQLVNSVFKSMQKADPETKALIREFALDILYASLRLPQTSAHTEVFSTLLMDPETYEPNKACIAYLLYVLKIIEL

SEQ ID NO: 967 - protein, 615 aa, Chlamydia pneumoniae
  CPn0965
KGFSFSKVGLNMIPSGLVYLLYPLGFLASLFFGSAFSIQWWLSKKRKEVYAPRSFWILSSIGATLMIVHGTIQSQFPVTVLHVINLIIYLRNLNITSSRPISFRATLVLMALSVVFVTLPFLYVNMEWMASPNIFHLPLPPAQLSWHLIGCLGLAIFSGRFLIQWFYIESNNTKDFPLLFWKIGLLGGLLALVYFIRIGDPINILCYGCGLFPSIANLRLFYKEQRSTPYLDTHCFLSAGEASGDILGGKLIQSIKSLYPNIRFWGVGGPAMRQEGLQPILNMEEFQVSGFAEVLGSLFRLYRNYRKILKTILKHKPATLIFIDFPDFHLLLIKKLRKHGYRGKIIHYVCPSIWAWRPKRKRILEQHLDMLLLILPFEEGLFKNTSLETVYLGHPLVEEISDYKEQASWKEKFLNSDRPIVAAFPGSRRGDISRNLRIQVQAFLNSSLSQTHQFVVSSSSAKYDEIIEDTLKAEGCQHSQIIPMNFRYELMRSCDCALAKCGTIVLETALNQTPTIVMCRLRPFDTFLAKYIFKILLPAYSLPNIIMNSVIFPEFIGGKKDFHPEEIATALDLLNQHGSKEKQKEDCRKLCKVMTTGQIASEEFLKRIFDTLPAV

SEQ ID NO: 968 - protein, 436 aa, Chlamydia pneumoniae
  CPn0966
LLITIIMVCENNILSGRGLELLKKKSNITLTPTIYSVSNHNIKLKDFSPHALSVIKTLRKAGYIAYIVGGCIRDLLLNTTPKDFDISTSAKPEEIKAIFKNCILVGKRFRLAHIRFSKQIIEVSTFRSGSTDEDVLITKDNLWGTPEEDVLRRDFTINGLFYDPEHEEIIDYTGGVNDLRNRYLRTIGDPFTRFKQDPVRMLRLLKILSRSPFTVETQTQEALIACRQELIKSSQARVFEELIKMLNSGAAKNFFQLLIENHLLEILFPYMDKAFRLNRALEEQTATYLKALDDKILKKEAEYDRHQLMAIFLFPLVNFNVRYKHQKHPYLSLTSVFDYIKNFLEQFFADSFTSCSKKNFILTALILQMQYRLTPLIPTKKALFFNKKLLHHTRFLEALSLLEIRSIVYPKLDKVYVAWIRHHQTLKCKKDSHSQK

SEQ ID NO: 969 - protein, 485 aa, Chlamydia pneumoniae
  CPn0967
FTAYKFAFICACRSEKIRRIGIDFRRNMQQSVRKLFGTDGVRGRANFEPMTVETTVLLGKAVARVLREGRSGKHRVVVGKDTRLSGYMFENALIAGLNSMGIETLVLGPIPTPGVAFITRAYRADAGIMISASHNPYRDNGIKIFSLEGFKISDVLEQRIETMVSEADFGPLPEDHAVGKNKRVIDAMGRYVEFVKATFPKGRTLKGLKIVLDCAHGASYKVAPSVFEELDAEVICYGCEPTGININEHCGALFPQVIQKAVIEHQAHLGIALDGDGDRIIMVDEKGHIVDGDMILSICAGDLKKRSALPHNRVVATIMTNFGVLKYLEGLGLQVFTSPVGDRHVLHAMLEHEVTLGGEQSGHMIFLDYNTTGDGIVSALQVLRIMIESESMLSDLTAPIVKSPQTLINVAVREKIPLETIPLIERTLRDVQDALGPSGRILLRYSGTENICRVMVEGHKKHQVDCLAKALADVIDAELGTGSRE

SEQ ID NO: 970 - protein, 611 aa, Chlamydia pneumoniae
  CPn0968
DRMCGIFGYLGNQDGVSIVLEGLAKLEYRGYDSAGLAAVVEQELFIRKTVGRVQELSNLFQEREIPTASVIGHTRWATHGVPTEINAHPHVDEGRSCAVVHNGIIENFKELRRELTAQGISFASDTDSEIIVQLFSLYYQESQDLVFSFCQTLAQLRGSVACALIHKDHPHTILCASQESPLILGLGKEETFIASDSRAFFKYTRHSQALASGEFAIVSQGKEPEVYNLELKKIHKDVRQITCSEDASDKSGYGYYMLKEIYDQPEVLEGLIQKHMDEEGHILSEFLSDVPIKSFKEITIVACGSSYHAGYLAKYIIESLVSTPVHIEVASEFRYRRPYIGKDTLGILISQSGETADTLAALKELRRRNIAYLLGICNVPESAIALGVDHCLFLEAGVEIGVATTKAFTSQLLLLVFLGLKLANVHGALTHAEQCSFGQGLQSLPDLCQKLLANESLHSWAQPYSYEDKFLFLGRRLMYPVVMEAALKLKEIAYIEANAYPGGEMKHGPIALISKGTPVIAFCGDDIVYEKMIGNMMEVKARHAHVIAIAPESREDIAAVSDQQIFVPDCHFLAAPVLYTIVGQVMAYAMALAKGMEIDCPRNLAKSVTVE

SEQ ID NO: 971 - protein, 399 aa, Chlamydia pneumoniae
  CPn0969 and CPn0970
VYVMSNKVLGGSLLIAGSAIGAGVLAVPVLTAKGGFFPATFLYIVSWLFSMASGLCLLEVMTWMKESKNPVNMLSMAESILGHVGKISICLVYLFLFYSLLIAYFCEGGNILCRVFNCQNLGISWIRHLGPLGFAILMGPIIMAGTKVIDYCNRFFMFGLTVAFGIFCALGFLKIQPSFLVRSSWLTTINAFPVFFLAFGFQSIIPTLYYYMDKKVGDVKKAILIGTLIPLVLYVLWEVVVLGAVSLPILSQAKIGGYTAVEALKQAHRSWAFYIAGELFGFFALVSSFVGVALGVMDFLADGLKWNKKSHPFSIFFLTFIIPLAWAVCYPEIVLTCLKYAGGFGAAVIIGVFPTLIVWKGRYGKQHHREKQLVPGGKFALFLMFLLIVINVVSIYHEL

SEQ ID NO: 972 - protein, 241 aa, Chlamydia pneumoniae
  CPn0971
EGSMGLYDRDYIQDSRVQGTFASRVYGWMTAGLIVTSCVALGLYFSGLYRSLFSFWWVWCFATLGVSFFINSKIQTLSVSAVGGLFLLYSTLEGMFFGTLLPVYAAQYGGGVIWAAFGSAALVFGLAAVYGAFTKSDLTKISKIMTFALIGLLLVTLVFAVVSMFVSMPLIYLLICYLGLVIFVGLTAADAQAIRRISSTIGDNNTLSYKLSLMFALKMYCNVIMVFWYLLQIFSSSGNRD

SEQ ID NO: 973 - protein, 316 aa, Chlamydia pneumoniae
  CPn0972
RCINNSLLFPSYLVSFLLLQLTLLLAMFKFFRNKLQSLFKKNISLDLIEDAESLFYEADFGTELTEELCARLRRTKKADASTIKDLITVLLRESLEGLPSQASQSSQTRPIVSLLLGTNGSGKTTTAAKLAHYYKERSESVMLVATDTFRAAGMDQARLWANELGCGFVSGQPGGDAAAIAFDGIQSAIARGYSRVIIDTSGRLHVHGNLMKELSKIVSVCGKALEGAPHEIFMTVDSTLGNNAIEQVRVFHDVVPLSGLIFTKVDGSAKGGTLFQIAKRLKIPTKFIGYGESLKDLNEFDLDLFLNKLFPEVEKI

SEQ ID NO: 974 - protein, 394 aa, Chlamydia pneumoniae
  CPn0973
EGKSKELFMHLHEYQAKDLLASYDVPIPPYWVVSSEEEGELLITKSGLDSAVVKVQVHAGGRGKHGGVIVAKSSAGILQAVAKLLGMHFTSNQTADGFLPVEKVLISPLVAIQREYYVAVIMDRKHRCPVLMLSKAGGMDIEEVAHSSPEQILTLPLTSYGHIYSYQLRQATKFMEWEGEVMHQGVQLIKKLAKCFYENDVSLLEINPLVLTLEGELLVLDSKITIDDNALYRHPNLEVLYDPSQENVRDVLAKQIGLSYIALSGNIGCIVNGAGLAMSTLDILKLHGGNAANFLDVGGGASQKQIQEAVSLVLSDESVKVLFINIFGGIMDCSVVASGLVAVMETRDQVVPTVIRLEGTNVELGKEIVQQSGIPCQFVSSMEEGARRAVELSM

SEQ ID NO: 975 - protein, 300 aa, Chlamydia pneumoniae
  CPn0974
VCRFRRYMFHSLSKNTPIITQGITGKAGSFHTEQCLAYGTNFVGGVTPGKGGTLWLDLPVYDSVLEAKQATGCRATMIFVPPPYAAEAILEAEEAGIELIVCITEGIPVRDMLEVARVMDNSTSQLIGPNCPGIIKPGECKIGIMPGYIHLPGNIGVVSRSGTLTYEAVWQLTQLKIGQSICVGIGGDPLNGTSFIDVLQALEEDPYTELILMIGEIGGSAEEEAAAWIQAHCTKPVVAFIAGVTAPKGKRMGHAGAIISGNSGDAKSKIQVLRESGVTVVESPAHIGKTVDAVLRAKEL

SEQ ID NO: 976 - protein, 200 aa, Chlamydia pneumoniae
  CPn0975
GIEEQVALSIAIKILKIILALILFPLVLLAWVIRYQLHANFHCSVVPFPGFSVNQAYKCSEAKIEEMLDLLDLETLEWSSRCLRQDMTFANRLEEELIQELRVSETEELISLGGKRNLVRLLLTHFFNPPKRSRVESVGHEVVFPVFDRLKREEEIIGDGPITRSNEELWALLDHGTARGIHKTLWFSIFFKYLTQIELF

SEQ ID NO: 977 - protein, 369 aa, Chlamydia pneumoniae
  CPn0976
ILMLVYCFDPSVPTSPEHRLMAALDRWFFLGGHRARILTLEGNHYRAFQENMSISTVEKILKLISYLLIPIVLIALLIRCFLHSRFKCNWKCDSLSDARVPHDVQPFNDFQLFNNQERLNIWKNRRYVSGIDVLMVPVDYLRSQFPGFKEIPEAIRCENYVSDGQFSEESKTSYLRAMLTDIVGYILSLDETYWTNVILKIRAMCITFESFPGKEADPNYSPRVTHHYFDESWKALARHVLGEGNMVNRLDEALIRTEKPGKEGECITKQFLKDYCKKHLEVMSCPDFIESLVDEKIREFRCPSILNSAVCDVIDRKCQEHLLKAIINEANRRLPGMKNSSFTMRGNQVLFYTIFSPPKLPPAASSVYF

SEQ ID NO: 978 - protein, 358 aa, Chlamydia pneumoniae
  CPn0977
LYINQFANILKSSFLMEVYSFSPSVRTSFQHRVMAALDNWFFLGGRRLKVVSLDSCNSGQACEEYVPISTTEKVLKILSYLLIPIVIIALLIRYLLHSNFTAKVSQKPWLKTLQLGIDIKSFILPGSHVNTMDSATLFKAIRLEGKRVDVEYHRLHSSDKVVFYIPAQKLPDDLRLTHWLPEKETRKTEYVRHMLAHVMGYLTSQGKERLQQVVQDSRSSTSLGAEKVLQYRFIDHPQSQGEFQRLLNENITTKGSEDKEVVQSDLFDMAFQCWWPQFISVIQSPTFSEELVHEMSQKLDLDCIYPEDDEFEQKFLNTLLKAVLHHGFEGISVASMGVIFLICPDSLALQIPFLRNQK

SEQ ID NO: 979 - protein, 347 aa, Chlamydia pneumoniae
  CPn0978
KYFFMEVYSFHPAVRTSFQHRVMAALDAWFFLGGHRLKVVSLDSCNSGWAYQELVSISTTEKVLKLLSYLLVPIVIIALLIRCLLHSNFRIDVEKERWLKIRELGIDIESCKLPSSYVNQVSSFIWFEKDKSKRPRIDVDYHTLHSKDWVVFPIVFQKIPKTSRFSYWFSQKETRKRDYVRNMLDHVIGYLTSEGGEWLQYISKTSYQSATSLDPERVLQYCLTDNQELQGEVQRLLNEESATKSSGDKEVLLSHVSDIICQCWWPKFLEVIQSPAFIEELVEEVSGKLNLDFLCLEKANTLDQELRNSLLRAVVHHGSEGVDIKKVGAGLIIYTEAIQLQIPFSRS

SEQ ID NO: 980 - protein, 491 aa, Chlamydia pneumoniae
  CPn0979
GIDMITKQLRSWLAVLVGSSLLALPLSGQAVGKKESRVSELPQDVLLKEISGGFSKVATKATPAVVYIESFPKSQAVTHPSPGRRGPYENPFDYFNDEFFNRFFGLPSQREKPQSKEAVRGTGFLVSPDGYIVTNNHVVEDTGKIHVTLHDGQKYPATVIGLDPKTDLAVIKIKSQNLPYLSFGNSDHLKVGDWAIAIGNPFGLQATVTVGVISAKGRNQLHIADFEDFIQTDAAINPGNSGGPLLNIDGQVIGVNTAIVSGSGGYIGIGFAIPSLMANRIIDQLIRDGQVTRGFLGVTLQPIDAELAACYKLEKVYGALVTDVVKGSPADKAGLKQEDVIIAYNGKEVDSLSMFRNAVSLMNPDTRIVLKVVREGKVIEIPVTVSQAPKEDGMSALQRVGIRVQNLTPETAKKLGIAPETKGILIISVEPGSVAASSGIAPGQLILAVNRQKVSSIEDLNRTLKDSNNENILLMVSQGDVIRFIALKPEE

SEQ ID NO: 981 - protein, 495 aa, Chlamydia pneumoniae
  CPn0980
FVMLNHAKKHAKPYVLIFFSTKDKLSYCDIIFNNCSGKPMNLDSKHFDINSANFLEEFAKFISFPSISADSDHLQDCENCAHFLVDHVNKIFDVELWETPGHPPIIYASYKSEDPLSPTLMLYNHYDVQPAQLSDGWKGDPFILREENGNLYARGASDNKGQCFYTLKALQHYYESQGNFPLNIIWLIEGEEESGSLALFTWLEKKKEALRADYLLIVDGGFLSEKHPYVSIGARGIVSMKISLEEGNKDMHSGVLGGIAYNTNRALSEILSSLHHPDNSIAIEGFYDDLALPSDSDRPDLPKSDTLRECEENLGFRPQGYEASYSPEESALRPTVEINGISGGYTGPGFKTVIPYRATAYLSCRLVPNQDPDKAAHQVIHHLKQQVPSSLKFSYEILPGGSRGWRSSANLPIVKVLQEIYSDLYNEECLRLVMPATIPIGPLLGEAAQTSPIICGTSYLSDDIHAAEEHFSMDQLKKGFLSICQLLDKLPKIKE

SEQ ID NO: 982 - protein, 978 aa, Chlamydia pneumoniae
  CPn0981
VTESMKAGDTYRNFIIKSCKDLPEIESKLLEAEHKPTGASIMMIVNNDEENVFNICFRTCPQTSNGVAHVLEHMVLCGSENYPVRDPFFSMTRRSLNTFINAFTGPDFTCYPAASQIPEDFYNLLSVYIDAVFHPLLTKQSFLQEAWRYEFNSENHLCYTGVVFNEMKGAMMSGEARLSEALNAAIFPSVTYGVNSGGEPREIVTLSHEDVRAFHQSQYSINRCLFYFYGNIKPSRHLDFLEEKLLRQATKLEKQAVSVPLQKRFKEPVRNILTYPVDHQEEDKVLFGISWLTCSILEQQELLALHVLEIILMGTDASPLKSRLLKSGFCKQTEMSIENDIREIPMTLVCKGCSPAGAQKLEALIFASLEEIIREGISENIVEGAVHQLELSRKEITGYSLPYGLSLFFRSGLLKQHGGSAEDGLRIHSLFSELRNSLKNSDYLAKLIRKYFLDNPHFARVILLPDTELVAKDNKDEQQLLLSVSEKLTDENKEKIQQNVRELTESQEQKEDLNGILPNLALDKVPTSGKEFPLIKEGLSQGEVLHHECFTNDIVFIDVVLDIPPLSGEELPWLRLLVFLMLQLGCGGRSYKEHLEFLLEHTGGVDVSYDFSPHANKNSFLSPSVSIRGKALSSKSEKLCGIVSDMLTSVDFTDIPRIRELLMQHNEALTNSVRNSPMSYAVSMACSGNSITGAMSYLTTGLPYVKKIRELTKNFDQNIDEAVVILQRLYTKCFSGKRQIVISGSAHNYQQLKDNKFYGLLDYLIVIPEPWENPSINLYVTSRGLHIPARAAFNALAFPIGDIAYDHPDAAALTVAAEILDNVVLHTKIREQGGAYGSGAAANLSRGSFYCYSYRDPEIATTYKTFLKGVSEIASGNFTKEDIYEGALGVVQGLDMPVAPGSRASVAFYRLKSGRIPVLRQAFRRSVLEVTKEHICMVMDKYLESTVQETTLISFAGEEMLRNNVLTLDKDFPIVPAI

SEQ ID NO: 983 - protein, 418 aa, Chlamydia pneumoniae
  CPn0982
KKELASVMNLPVSLACLLLSGCVFFLGVFVSSSLYARKKRAFLEKIQKLEHENQLLQTSLNLSRHQEQLIEDFSNRLALSSHKLIKDMKEEAQNYFGDTSKSFQSILSPIQTTLTTFKQSLETFETKHAEDRGRLKEQISQLLAVEKKLEHETHVLTDILKHPGSRGRWGEIQLERILELAGMLKYCDYDSQTTSAQGAFRADIIIRLPQDRCLIIDAKAPISDSYFSVEEIDKGDLVDKIKEHIKTLKSKSYWEKFHQSPEYVILFLPGESLFNDAIRLAPELMEIGASSNVILSSPLTLLALLKTIAYMWKQENLQKQIQEVSLLGKELHRRLQVVFTHFQKIGKNLNQTVQSYNDMTSSFQYRVLPTLRKFEGLETSSSHQIEEPTPIESLATSFPHTCDIDTNLAVIESLEKQD

SEQ ID NO: 984 - protein, 280 aa, Chlamydia pneumoniae
  CPn0983
KNPLCYEQKKLWQIDMAGLDLEARGKRRVVTPNAITAFGLCCGLFIIFKSVLRTSSSVELFHRLQGLSLLLISAMIADFSDGAIARIMKAESAFGAQFDSLSDAVTFGIAPPLIAIKSLDGIYVGNFFSSLLLITSIIYSLCGVLRLVRYNLFSQKTVDVSKPYCFIGLPIPAAAASIVSLALFLASDFFPDLPAQLRVGLLSFALLFIGGLMISPWKFPGVKHFRFNVSSFLLVVTIGLAACLFFSGLVDHFVEVFFLVSWLYTLVGFPIFSIIYRKKS

SEQ ID NO: 985 - protein, 1047 aa, Chlamydia pneumoniae
  CPn0984
GKVMVEVEEKHYTIVKRNGMFVPFNQDRIFQALEAAFRDTRSLETSSPLPKDLEESIAQITHKVVKEVLAKISEGQVVTVERIQDLVESQLYISGLQDVARDYIVYRDQRKAERGNSSSIIAIIRRDGGSAKFNPMKISAALEKAFRATLQINGMTPPATLSEINDLTLRIVEDVLSLHGEEAINLEEIQDIVEKQLMVAGYYDVAKNYILYREARARARANKDQDGQEEFVPQEETYVVQKEDGTTYLLRKTDLEKRFSWACKRFPKTTDSQLLADMAFMNLYSGIKEDEVTTACIMAARANIEREPDYAFIAAELLTSSLYEETLGCSSQDPNLSEIHKKHFKEYILNGEEYRLNPQLKDYDLDALSEVLDLSRDQQFSYMGVQNLYDRYFNLHEGRRLETAQIFWMRVSMGLALNEGEQKNFWAITFYNLLSTFRYTPATPTLFNSGMRHSQLSSCYLSTVKDDLSHIYKVISDNALLSKWAGGIGNDWTDVRATGAVIKGTNGKSQGVIPFIKVANDTAIAVNQGGKRKGAMCVYLENWHLDYEDFLELRKNTGDERRRTHDINTASWIPDLFFKRLEKKGMWTLFSPDDVPGLHEAYGLEFEKLYEEYERKVESGEIRLYKKVEAEVLWRKMLSMLYETGHPWITFKDPSNIRSNQDHVGVVRCSNLCTEILLNCSESETAVCNLGSINLVEHIRNDKLDEEKLKETISIAIRILDNVIDLNFYPTPEAKQANLTHRAVGLGVMGFQDVLYELNISYASQEAVEFSDECSEIIAYYAILASSLLAKERGTYASYSGSKWDRGYLPLDTIELLKETRGEHNVLVDTSSKKDWTPVRDTIQKYGMRNSQVMAIAPTATISNIIGVTQSIEPMYKHLFVKSNLSGEFTIPNTYLIKKLKELGLWDAEMLDDLKYFDGSLLEIERIPNHLKKLFLTAFEIEPEWIIECTSRRQKWIDMGVSLNLYLAEPDGKKLSNMYLTAWKKGLKTTYYLRSQAATSVEKSFIDINKRGIQPRWMKNKSASTSIVVERKTTPVCSMEEGCESCQ

SEQ ID NO: 986 - protein, 380 aa, Chlamydia pneumoniae
  CPn0985
ISVHKYCGRKKNNPRLFNGRRLRILSITEKRGAKMEADILDGKLKRVEVSKKGLVNCNQVDVNQLVPIKYKWAWEHYLNGCANNWLPTEVPMARDIELWKSDELSEDERRVILLNLGFFSTAESLVGNNIVLAIFKHITNPEARQYLLRQAFEEAVHTHTFLYICESLGLDEGEVFNAYNERASIRAKDDFQMTLTVDVLDPNFSVQSSEGLGQFIKNLVGYYIIMEGIFFYSGFVMILSFHRQNKMTGIGEQYQYILRDETIHLNFGIDLINGIKEENPEVWTTELQEEIVALIEKAVELEIEYAKDCLPRGILGLRSSMFIDYVRHIADRRLERIGLKPIYHSRNPFPWMSETMDLNKEKNFFETRVTEYQTAGNLSW

SEQ ID NO: 987 - protein, 228 aa, Chlamydia pneumoniae
  CPn0986
FLLFMKPQDLSPPFLWKERRPCIQDGVLYVPRHYFEHQNFSTSYHQEFFQNHTSIACELCSGNGDWVVAQAQKDPQVLWIAVEQRFDRVRKIWSKMINHQIQNLRIVCGTAETFFQYYVPDQFLQRLVVNFPDPWPKMRHRKHRLLQPSFVQEISRSLQDSAVFALATDDKTYLLESIEALQTHLAPRMETPYYIKMTDTYGNSWFENLWRTKGQEIFYTEFIKKAGI

SEQ ID NO: 988 - protein, 211 aa, Chlamydia pneumoniae
  CPn0987
LENGIFAIGFFMFAYRTLLTHNVVQVSHEIFKTTVVPGDTVIDATCGNGNDSLFLARLLQGEGRLVVYDIQKEALSNALLLFETHLSEQERSVIEMKEQSHEHILEKDVKLIHYNLGYLPKGNKEITTLARTTEISLEYALNIVRPDGLITVVCYPGHPEGEKETHSVESLAQRLHPKEWCVSSFYVANRCRAPRLFIFQRQGSESSVDKG

SEQ ID NO: 989 - protein, 319 aa, Chlamydia pneumoniae
  CPn0988
KFFINLINLDQGILKMKEAAPMHFPFPVRRSVWLNRYSTFRIGGPANYFKAIHTIEEAREVIRFLHSINYPFLIIGKGSNCLFDDRGFDGFVLYNAIYGKQFLEDARIKAYSGLSFAALGKATAYNGYSGLEFAAGIPGSVGGAIFMNAGTNESDISSVVRNVETINSEGELCSYSVEELELSYRSSRFHRQQEFILSATFQLSKKQVSADHSKSILQHRLMTQPYTQPSAGCIFRNPEGTSAGKLIDAAGLKGLAIGGAQISPLHANFIINTGKATSDEVKQLIAIIQSTLKTQGIDLEHEIRIIPYQPKIHSPVSEK

SEQ ID NO: 990 - protein, 179 aa, Chlamydia pneumoniae
  CPn0989
LRTSLAVKCVLLTIFWLLVMATLSPEKFSGSPISISKEFPQQKMREIILQMLYALDMAPSAEDSLVPLLMSQTAVSQKHVLVALNQTKSILEKSQELDLIIGNALKNKSFDSLDLVEKNVLRLTLFEHFYSPPINKAILIAEAIRLVKKFSYSEACPFIQAILNDIFTDSSLNENSLSI

SEQ ID NO: 991 - protein, 187 aa, Chlamydia pneumoniae
  CPn0990
SVALNFKINRQIRAPKVRLIGSAGEQLGILAIKDALDLAREAGLDLVEVASNSEPPVCKIMDYGKYRYGLTKKEKDSKKAQHQVRIKEVKLKPNIDENDFSTKLKQARTFVEKGNKVKITCMFRGRELAYPEHGFKVVQKMSQGLEDIGFVEAEPKLAGRSLICVVAPGTVKTKKKQEKSHAQDENQ

SEQ ID NO: 992 - protein, 73 aa, Chlamydia pneumoniae
  CPn0991
KQRKNRKSLMPKMKTNKSVSARFKLTASGQLKRTRPGKRHKLSKKSSQEKRNLSKQPLVDKGQVGMYKRMMLV

SEQ ID NO: 993 - protein, 125 aa, Chlamydia pneumoniae
  CPn0992
GKLVMVRATGSVASRRRRKRILKQAKGFWGDRKGHIRQSRSSVMRAMAFNYMHRKDRKGDFRSLWIARLNVASRIHSLSYSRLINGLKCANISLNRKMLSEIAIHNPEGFAEIANQAKKALEATV

SEQ ID NO: 994 - protein, 352 aa, Chlamydia pneumoniae
  CPn0993
KSFGSHSLGIRISMEMKEEIEAVKQQFHSELDQVNSSQALADLKVRYLGKKGIFRSFSEKLKQCTDKAKLGSLINDFKTYVEDLLQEKSLVLLASEQAEAFSKEKIDSSLPGDSQPSGGRHILKSILDDVVDIFVHLGFCVREAPNIESEANNFTLLNFTEDHPARQMHDTFYLNATTVLRTHTSNVQARELKKQQPPIKVVAPGLCFRNEDISARSHVLFHQVEAFYVDHNVTFSDLTAILSAFYHSFFQRKTELRFRHSYFPFVEPGIEVDVSCECCGKGCALCKHTGWLEVAGAGMIHPQVLRNGNVDPEIYSGYAVGMGIERLAMLKYGVSDIRLFSENDLRFLQQFS

SEQ ID NO: 995 - protein, 690 aa, Chlamydia pneumoniae
  CPn0994
LFWFHRGGRMKRSRRNFEQALENLEKLKEISLATSNDSYLNNPARFNQRKQTGSSVMEMKEALKNVENYLLEISCVSKSHADKALKESDFLIAGVQNVFSFLENQEDLYKSLLDEYSEVTKAYDEVKKNLKEVPTYDLSTDEETEEHKEPECFLNNLVEVKRDRSYELFYMLDEQDKRFYNDALVQIIYKQNKLHETVNEGDPLTKTLLWNSEEVKNIASSLVIVNDMPLRLFYQRALSHLDIEAVVKVHNAVMALFFSRYEATMVFKSPKKHNIWYFNDFLLFLREAWKDLNNNVIDSQERKQTKLLASALSLGIFESKLVFEEASRYLYFNIQTKLENANGKKPLSPGQYLTDAYEELHRLISKYPNGPLFKAMDRVLEHESRPYDPMILGILPSLEGTLKLHGKSIDIIRSPSPVTQSSILYANCNEEFLGFLNAKAHRSEVTLVLNIQNRISRKERARSRVIEEALEQEEHAPYVHAFSFPEPEELLQNLESIHGDIETFADFFSILQEEFHKPLLASSFFLTKELKEFVGSFLKEKLTALKDIFFAKKKILFRNDKLLLLHLLSYLIVFKLIERTNPNSIVVVSKDGLDYVSVFIAGFAFFSREAFWDEHSLKLLLTNVLSPTLVARDRLVFVSHIELLSKFVNCLKKNRQGFSSLKSFFKDDIEGWEFTGYLHELTEVSHKHNL

SEQ ID NO: 996 - protein, 367 aa, Chlamydia pneumoniae
  CPn0995
RMLIWKRHLLTRFWFALTSLLVLALIFYASIHHSLHTLKGASTAASGASVKLSILYYLAQISLKAEFLMPQLVAVATTSTLFAMQNKREIILLQASGLSLKSLMHPLLLSGAVIMMVLYANFQWLHPICEKISITKENMDRGTTDKEQGKIPALYLKDQTVLLYSSIEPKTLTLNNVFWIKDPKTIYTMEKLAFTTLSLPIGLNVTQFFANDSENLELKEFFDMKEFPEIEFNFYENPFSKLFSAGNKNRLSEFFKAIPWNATGLGLSTQVPQRILSLLAQFYYVLISPLACMAAIILSAYLCLRFSRTPTVTLAYLIPLGTVNIFFVFLKAGIVLASSSVLPTLPVMAFPLIVLFLLTNYAYAKLQ

SEQ ID NO: 997 - protein, 358 aa, Chlamydia pneumoniae
  CPn0996
AMPILWKVLIFRYLKTAAFCTLSLICISIISSLQEIVAYIAKDVPYDTVLRLMAYQIPYLLPFILPGSCFVSAFSLFRKLSDNNHMTFLRASGASQSIIMFPVLMVSGAICCLNFYTCSELASICRYQTCKEIANMAMTSPALLLQTLQKKENNRIFIAVDHCAKSKFDNVIVALKGNNEISHVGIIKSIIPDTTKDTVKAKDVVFISKLPDSLTESSSPSSQRFYIETLDELLIPKITSTLFAGKSYLKTRTDYLPWKQLVKQSLKHSHLPETLRRVAIGFLCITLTYAGMILGIHKPRFRKSIALYFIFPILDLILLIVGKNTKNLPLAFMLFVFPQLVSWVVFAARAYRESRGYA

SEQ ID NO: 998 - protein, 322 aa, Chlamydia pneumoniae
  CPn0997
AYKMVLSSDLLRDDKQLDLFFASLDVKKRYLLALSGGSDSLFLFYLLKERGVSFTAVHIDHGWRSTSAQEAKELEELCAREGVPFVLYTLTAEEQGDKDLENQARKKRYAFLYESYRQLDAGGIFLAHHANDQAETVLKRLLESAHLTNLKAMAERSYVEDVLLLRPLLHIPKSSLKEALDARGISYLQDPSNEDERYLRARMRKKLFPWLEEVFGKNITFPLLTLGEESAELSEYLEKQAQPFFSAATHQDSQGELPCPDCLIQQAFLCKWVMKKFFNNAGIAVSRHFLQMVYDHLSRSSCATLRMRNKIVIIKPGVVVID

SEQ ID NO: 999 - protein, 918 aa, Chlamydia pneumoniae
  CPn0998
LISLVVKFMSKDKKMKPEPKKNFPTVFFFLLFGVVFGVVAFQNFLAGKKARVGFSHQIEHLVNLRLIVPEDSHKIALNDNLVSFGGRFRDVQTQEGQLRYHYLELIDQGHRLDLDLQETSKSLTTLGKEVTNSILWFSAISGSPIPEQGYAISYPSEVSGSVLTEPLVVTGPATPQLINLHSLQERYPTLSRSPEALRTYGSDLYELIGKYLSPVLGIGSETLKRELKDLYQQVEVSLTQETDTEAAYTLYGQVLSTLNRISSSLVVSEGGERFSQLRSVRLYREEWNKYHKLVEARDLNQAQLEKLRGELSQTVWYFNNQELSSRSLEKQDPEVFGHWFAGAKEEWTAFKFNHSLSFKAPDQPRNLVLEKTFKSQEPSPHYLGYLFTFLPIILVLLFVYLVFSRQMRGMSGSAMSFGKSPARMLLKGQNKVTFADVAGIEEAKEELIEIVDFLKNPNKFTSLGGRIPKGVLLIGPPGTGKTLIAKAVSGEADRPFFSIAGSDFVEMFVGVGASRIRDMFEQAKRNAPCIIFIDEIDAVGRHRGAGIGGGHDEREQTLNQLLVEMDGFGTNEGVILMAATNRPDVLDKALLRPGRFDRRVVMNLPDIKGRFEILMVHAKRIKLDPTVDLMAVARSTPGASGADLENLLNEAALLAARKDRTAVTAVDVAEARDKVLYGKERRSLEMDAEERKTTAYHESGHAVVGLCVQHGDPVDKVTIIPRGLSLGATHFLPEKNKLSYWKKELYDQLAVLMGGRAAEEIFLGDISSGAQQDISQATKLVRSMVCEWGMSPQLGNVTYDERSDGLTGYGGYHEKSYSEETAKTIDTELRMLLDAAYQRALDIINEHKAEIELMTQMLIEFETLDSKDVKEIMDHTWDPEKKRARLKEEGMLFKKSSDDLPPPPPKEDTLPGLGFNAT

SEQ ID NO: 1000 - protein, 698 aa, Chlamydia pneumoniae
  CPn0999
QETFMNFQTISINLTEGKILVFETGKIARQANGAVLVRSGETCVFASACAVDLDDKVDFLPLRVDYQEKFSSTGKTLGGFIKREGRPSEKEILVSRLIDRSLRPSFPYRLMQDVQVLSYVWSYDGQVLPDPLAICAASAALAISDIPQSNIVAGVRIGCIDNQWVINPTKTELASSTLDLVLAGTENAILMIEGHCDFFTEEQVLDAIEFGHKHIVTICKRLQLWQEEVGKSKNLSAVYPLPAEVLTAVKECAQDKFTELFNIKDKKVHAATAHEIEENILEKLQREDDDLFSSFNIKAACKTLKSDTMRALIRDREIRADGRSLTTVRPITIETSYLPRTHGSCLFTRGETQTLAVCTLGSEAMAQRYEDLNGEGLSKFYLQYFFPPFSVGEVGRIGSPGRREIGHGKLAEKALSHALPDSATFPYTIRIESNITESNGSSSMASVCGGCLALMDAGVPISSPIAGIAMGLILDDQGAIILSDISGLEDHLGDMDFKIAGSGKGITAFQMDIKVEGITPAIMKKALSQAKQGCNDILNIMNEALSAPKADLSQYAPRIETMQIKPTKIASVIGPGGKQIRQIIEETGVQIDVNDLGVVSISASSASAINKAKEIIEGLVGEVEVGKTYRGRVTSVVAFGAFVEVLPGKEGLCHISECSRQRIENISDVVKEGDIIDVKLLSINEKGQLKLSHKATLE

SEQ ID NO: 1001 - protein, 101 aa, Chlamydia pneumoniae
  CPn1000
SAFAAIILRRHPMSLDKGTKEEITKKFQLHEKDTGSADVQIAILTEHIAELKEHLKRSPKDQNSRLALLKLVGQRRKLLEYLNSTDTERYKNLITRLNLRK

SEQ ID NO: 1002 - protein, 167 aa, Chlamydia pneumoniae
  CPn1001
YYLELGGEKLINMEKDIFFMQQAFKEARKAYDQDEVPVGCVIVKDDKIIARAHNSVEKLKDATAHAEILCIGSAAQDLDNWRLLDTVLYCTLEPCLMCAGAIQLARIPRIVWAAPDVRLGAGGSWVNIFTEEHPFHTVSCTGGVCSEEAEHLMKKFFVEKRREKSEK

SEQ ID NO: 1003 - protein, 82 aa, Chlamydia pneumoniae
  CPn1002
KSAERKVKNKIVTLLDQLYEDQESRLQKLGEEIVPNLTPEDLLQPMDFPQLEGNPAFRFEEGVLSGIGEVRAAILAALSQEN

SEQ ID NO: 1004 - protein, 257 aa, Chlamydia pneumoniae
  CPn1003
TSNKTIHPLLWGPDRQIAGKASMRVIFPDKHNNFPNLSKLLKKLPSVILVTSCIAPFFSYIINKFFGIPGLLEILALSVKGIQKHHFWQFLTYPLITADSLSLNKDQSFEITQRLLLRNVLDFFLFYKAIQHLIRKLGAFSVLVVISGQALIIGAVLWGFMALIHSSQSFFGPESIICGVLTVQIFLDPEKRFTIGPTPLSVSIKWGFLFVLGFYCCILIFSGAFLLLLASMLAIVLAILFCKKEKIPNPYTTSLRF

SEQ ID NO: 1005 - protein, 180 aa, Chlamydia pneumoniae
  CPn1004
HLSIEELMSIQPVSNTTTKADKVIPDSTKVISDSITINKQSAFYFCISVMLRLSESTTEYGKSILAVLEDNTIVQQQRVKELINLPLLKVPDLQKKDGSDDEYKNQNEIQAYQSSNQQISANRQMIQQELSSAQQRAQANQKSVNSTTIESMQILQATSSMLSTLKELTIKANLTNSPSD

SEQ ID NO: 1006 - protein, 181 aa, Chlamydia pneumoniae
  CPn1005
NRKPVRLNMWIIDPLSAKKPLQAAINVPGTPITGGPNTATADDIIAKFSKDSNPLIVTVYYVYQSVLVAQDNLSIIAQELQANSSAQTYLNNQEALYQYVSIPKNKLNDNSSSYLQNIQSDNQAIGASRQAIQNQISSLGNAAQVISSNLNTNNNIIQQSLQVGQALIQTFSQIVSLIANI

SEQ ID NO: 1007 - protein, 168 aa, Chlamydia pneumoniae
  CPn1006
TKVNFFIMSITTLGTLPTVNTINSSRPPLEPLNTPKIGAVLFSIYELLLQAIEIRQQTVLTQSQQLNDNTNIQQQLNQETNQIKYAIVSAGAKEDEITRVQNQNQNYSAQRSNIQDELVTTRQNGQIILSHASTNINIIQQQSSQDSSFIKTTNSIGSTVNQLNKPLG

SEQ ID NO: 1008 - protein, 73 aa, Chlamydia pneumoniae
  CPn1007
LWYKSLAGEEKDVSGNECNDYPEVFKDDVSAYVLVTCGQMSSEGKIQVEMTYEGDPAVISYLLTKARDSLDES

SEQ ID NO: 1009 - protein, 440 aa, Chlamydia pneumoniae
  CPn1008
VLNYSFIGMLKPMYVLSKRLYRWVNQLIKLGDLVKNSRSFSVEWVFISALLLIFGCLGCASVVKVSLVPFLLLFSFLAFPLILCFRGKGYALLLGVFVTLYVAKYVVGETLYVSFWLSGLGVSFLLAFGLFLQGVWLAQEEEMVKGKEQLRLSEDLDAQRSAYEDLLLTKSQEKEFLDARAQGLDRELTECQELLKAAYQKQEYLTIDLKILADQKNSWLEDYAELHNKYIELVSKNGDVVFPWVAEPSVGESQGSERVDVSRWVSALQEKEESLERLRNEILVEKQRCSDYEHRCQELGLLLQNFTALERRCEELQNLLNQKETQINELHQLVCKSEEKVSVEPSAHAETSCVEEKQYKGLYSQLQEQFLEKSETLSLVRKKLFAVQEKYLTLKKKEELTKQDISFDDISMIQGLLERIEILEEEVSHLEELVSRSLSL

SEQ ID NO: 1010 - protein, 300 aa, Chlamydia pneumoniae
  CPn1009
YRLLHRVILMKRNDPCWCGSGRKWKQCHYPQPPKMSPEALKQHYASQYNILLKTPEQKAKIYNACQITARILDELCKASQKGVTTNELDELSQELHKKYDAIAAPFHYGSPPFPKTICTSLNEVICHGIPNDIPLKDGDIMNIDVSCIVDGYYGDCSRMVMIGEVPEIKKKICQAALECLNDSIAILKPGIPLCEIGEAIEARADTYGFSVVDQFVGHGVGIEFHENPYVPHYRNRSMIPLAPGMIFTIEPMINVGKKEGVVDPKNQWEARTCDNQPSAQWEHTIAITETGYEILTLLND

SEQ ID NO: 1011 - protein, 203 aa, Chlamydia pneumoniae
  CPn1010
VMLILLNLSLLFYVLFDSPGSIPVFVALLKNFSRKKQQRVILRECLFALGALILFVTFGRSFFQFLDISLYAFQIIGGFLLFTVSIKMMLAPMPEKAKDDTSKTEPIFFPLAFPVITGPAVITALLSYMEEGIYSREIIFTAMIIAWAFSLFTLLCSSFFDRLFGNFGLLALERLFGIALLLMSVNLMLKGISIAFNIGFYIG

SEQ ID NO: 1012 - protein, 136 aa, Chlamydia pneumoniae
  CPn1011
EMRLKNYPMIQFSFFLPQTCILLLASDSLTNILALHHLLANYSVKQRMLVLLRESFFAFIAMFALYGLALGGLKVLNTPVCAIEVVGGIAVTLAGVRAVLRLGKEESWIPYKFNMSPSYSPCISPIALPLMFGPSG

SEQ ID NO: 1013 - protein, 600 aa, Chlamydia pneumoniae
  CPn1012
AIFSLITSKMKKKFIFYFVIVFSLLFLWEMTSRHRPTFSFFCPPPSSIASSTLQSLPLLLTSAWHTLKAILGGFFLAITLSIVLATIMLSYKSAKDLLQPLFILLQCTPMFALAPLIVLWFGWGIGAVIVPTALTIFFPLTLTIYQGILSTPEELIEQFVLCGATKFQLLIKLRIPHALPHIFSGLKIAIGSAGFAAIAGEWVASQSGLGILMLESRRNYEMELAFAGLATLSILTLSLFQITLLIEKLIFSLFRVKRMSLKHKSVAKKALSVLALIPIMLIPWKGNSKSPPDKKNLTSLTLLLDWTPNPNHIPLYAGVAKGYFKQHGLDLQLQKNTDSSSAVPHVLFEQVDMALYHALGIMKTSIKGMPIQIVGRLIDSSLQGFLYRSQDPIYKFEDLNGKVLGFCLNNSRDLNRLLETLNRNGVVPSEVKNVSSDLISPMLLNKIDFLYGAFYNIEGVKLQTLGMPVKCFLSDTCDLPTGPQLIVFTKKGTKASEPEIVEAFQKALQESIIFSKDHPEDAFKLYAKETKSIPKNLYQEYLQWEETFPLLAQSQDPLSKDLVDKLLETIIKRYPELASEVAKFSLNDLYNPSLPEEQSV

SEQ ID NO: 1014 - protein, 472 aa, Chlamydia pneumoniae
  CPn1013
RENSLNHRGNIDMRQEKDSLGIVEVPEDKLYGAQTMRSRNFFSWGPELMPYEVIRALVWIKKCAAQANQDLGFLDSKHCDMIVAAADEILEGGFEEHFPLKVWQTGSGTQSNMNVNEVIANLAIRHHGGVLGSKDPIHPNDHVNKSQSSNDVFPTAMHIAAVISLKNKLIPALDHMIRVLDAKVEEFRHDVKIGRTHLMDAVPMTLGQEFSGYSSQLRHCLESIAFSLAHLYELAIGATAVGTGLNVPEGFVEKIIHYLRKETDEPFIPASNYFSALSCHDALVDAHGSLATLACALTKIATDLSFLGSGPRCGLGELFFPENEPGSSIMPGKVNPTQCEALQMVCAQVLGNNQTVIIGGSRGNFELNVMKPVIIYNFLQSVDLLSEGMRAFSEFFVKGLKVNKARLQDNINNSLMLVTALAPVLGYDKCSKAALKAFHESISLKEACLALGYLSEKEFDRLVVPENMVGNH

SEQ ID NO: 1015 - protein, 575 aa, Chlamydia pneumoniae
  CPn1014
ALASTLGYCIVKVPWAFKNFIPKLYTSIKEGYSFNTFKKDFQAGITVGILAFPFAIAIAIGVGVSPIQGLLASIIGGLLASAMGGSNVLISGPSSAFISILYCLSAKYGAEALFTVTLLAGVFLIAFGLTGLGTFIKYMPYPVVTGLTTGLAIIIFSSQIKDFLGLQMGANIPADFLPKWIAYWDHLWTWDSKSFAVGLFTLLIMIYFRNYKPRYPGVMIAIVTATTLVWLLKIDIPTIGSRYGTLPTAIPLPKIPQLSITKILQLMPDALTIAVLSGLETLLSAVVADGMTGWRHQSNCQLVAQGVANIGTSLFSGIPVTGSLSRTAASIKSEATTPIAGIVHSIFICFILLLLAPLTVKIPLTCLAAVLILIAWNMSEIHHFIHLFTAPKKDIVVLLTVFILTVMTTITAAVQVGMMLAAFLFMKQMSDLSDVISTAKYFDKDSDFLSKAEVPQNTEIYEINGPFFFGIADRLKNLLNDIEKPPKIFILCMTRVPTIDASAMHALEEFFLECDRQGTLLLLAGVKKTPLADLKRYHLDELIGVDHIFSNIKSALLFAQALTNLESKTSTRHLV

SEQ ID NO: 1016 - protein, 448 aa, Chlamydia pneumoniae
  CPn1015
KNNYKNFSFFTSVRVRSKVDHEIILEVTMLKLQLCALFLFGYLAIVFEHIVRVNKSAIALAMGGLMWLVCFSHIPMADHMILVEEIADMSQVIFFLFSAMAIVELIDAHKGFSVIVKFCRIQSRTLLLWALIGLSFFLSAALDNLTSIIIIISILKRLVKAREDRLLLGAICVIAVNAGGAWTPLGDVTTTMLWINNKITSWGIIRALFVPSLVCVLVAGFCGQFFLRKRGSTLIAKDVELQSAPPKSLWIIFIGLGSLLMVPVWKACLGLPPFMGALLGLGLVWLTSDWIHSPHGEDRYHLRVPHILTKIDISSITFFIGILLAVNALSFANLLTDFSLWMDKIFSRNVVAIVIGLLSSVLDNVPLVAATMGMYTLPLDDTLWKLIAYAAGTGGSILIIGSAAGVAFMGLEKVDFLWYFKRISWIALASYFGGLFSYFVLESLNFFI

SEQ ID NO: 1017 - protein, 624 aa, Chlamydia pneumoniae
  CPn1016
KREVFMKKGKLGAIVFGLLFTSSVAGFSKDLTKDNAYQDLNVIEHLISLKYAPLPWKELLFGWDLSQQTQQARLQLVLEEKPTTNYCQKVLSNYVRSLNDYHAGITFYRTESAYIPYVLKLSEDGHVFVVDVQTSQGDIYLGDEILEVDGMGIREAIESLRFGRGSATDYSAAVRSLTSRSAAFGDAVPSGIAMLKLRRPSGLIRSTPVRWRYTPEHIGDFSLVAPLIPEHKPQLPTQSCVLFRSGVNSQSSSSSLFSSYMVPYFWEELRVQNKQRFDSNHHIGSRNGFLPTFGPILWEQDKGPYRSYIFKAKDSQGNPHRIGFLRISSYVWTDLEGLEEDHKDSPWELFGEIIDHLEKETDALIIDQTHNPGGSVFYLYSLLSMLTDHPLDTPKHRMIFTQDEVSSALHWQDLLEDVFTDEQAVAVLGETMEGYCMDMHAVASLQNFSQSVLSSWVSGDINLSKPMPLLGFAQVRPHPKHQYTKPLFMLIDEDDFSCGDLAPAILKDNGRATLIGKPTAGAGGFVFQVTFPNRSGIKGLSLTGSLAVRKDGEFIENLGVAPHIDLGFTSRDLQTSRFTDYVEAVKTIVLTSLSENAKKSEEQTSPQETPEVIRVSYPTTTSAS

SEQ ID NO: 1018 - protein, 313 aa, Chlamydia pneumoniae
  CPn1017
VIIMRKLILCNPRGFCSGVVRAIQVVEVALEKWGAPIYVKHEIVHNRHVVNALRAKGAIFVEELVDVPEGERVIYSAHGIPPSVRAEAKARKLIDIDATCGLVTKVHSAAKLYASKGYKIILIGHKKHVEVIGIVGEVPEHITVVEKVADVEALPFSSDTPLFYITQTTLSLDDVQEISSALLKRYPSIITLPSSSICYATTNRQKALRSVLSRVNYVYVVGDVNSSNSNRLREVALRRGVPADLINNPEDIDTNIVNHSGDIAMTAGASTPEDVVQACIRKLSSLIPGLQVENDIFAVEDVVFQLPKELRCS

SEQ ID NO: 1019 - protein, 245 aa, Chlamydia pneumoniae
  CPn1018
RMSYFNYQKNSVVLRSLGLLAKFFSRLLYRVFFSFREGIYLFSSLYLKYPRLFFYDLGKYVYSLRHCPYAKLGRLPGASLLKEGNVYGETPWSVLAKICQAFDITSQDILYDLGCGLGKVCFWFSHVVRCQVIGIDNQPHFIRFSSNMHRKLSSGFALFDTEEFKNVVLSQASYVYFYGSSFSRRLLNEIILKLSEMAPGSVVISISFPLDSFSRGKECFFTEKSCSVRFPWGKTIAYKNIRKGS

SEQ ID NO: 1020 - protein, 503 aa, Chlamydia pneumoniae
  CPn1019
IHRRNIMTVSYQSISTPPPEGEFDIFVDGNATEEAVVAAEVQVALPAGEQYAMLRATSELCFGILTQSECALTQALPPKEKPLQEEQFLVKNGILMRSTSLPNLKPGQSQQTSLASHRNPLAQQSTSSNSTGKASTETTSSSFPFFSCKAPEGDSSVDKTFTVSVQTPKAQEQQEASASQSQAQFHVRSYSSSTIKEHSAKEKVSQSTKSAETQKHTQTKSDATLSPMSLYSTLHKEVPQALSSTKSQQKDEEHRDQRQQEGYEQEQEQEEGKKKTPWCTVESLQQTSSSNQVYESYTPIIPDPIVEFALSESQLSVLAGKRVTNLDVLRICTELMKLMLKSRANDTMTRLEERELMEREAHELAASYSRQAKYARWLGIATATLGILGAIAPMVGEISGDSILGFVQRISGRFKDATAKTFFKGIGKVFTSLSQLTEAASKVHELSESAVRAVAEYRKEVFRMRQDEVTRTIEEVKDNWKSMDNFLLNILQTEHDAARSLYQ

SEQ ID NO: 1021 - protein, 515 aa, Chlamydia pneumoniae
  CPn1020
CGNSTMSSWLSQASEVLLNQDPYIPDAPRSQESSVPKISYSITVAPQEAQKSLPKFFTQKFQSQCKSEPPITHHKTFIIATPRERILRFGSSFESQLHNTSQAQTSSPWNLFSQKNSTEASKALMQELTMPKSPEKTSEKALDKNLSSKQEGSCKNFDTLHLQQHLKLFGTVDSLYSQSLDSEQQELLQSRREERSETYANQQSSEKKIETKVQIKDLCKDLFSQDQDSNQKQKKSPFQQDTSRKNRIAKAAQAVPVIPPPSIGVFTLSYLLTKQGILSDFSSYGCHKDSVESTQRELDALHEKRIETIKVSIEKEKRERLWGSLSDIIGWLAPFVSIGIGIVAILSGGGIFAFAGFFAGLISLVIKCLEKLKFWDWLEKHLPIKNEELRRKIITIIQWVVYLTPVILSICTLKVENLGFSPIIEGAIKGIQPAIESTMAALRCAILFSQAEIYKLKGKLTKIQLDIELKSFDRDDHYERSQELLDNMESSFEALSRILNYMRELDQVYLHSLRG

SEQ ID NO: 1022 - protein, 191 aa, Chlamydia pneumoniae
  CPn1021
CIEVIERTYGHLHLQPTPLMSHLNYLLEKIAASSKEDFPFPDDLESYLEGYVPDKNIALDTYQKIFKISSEDLEKVYKEGYHAYLDKDYAKSITVFRWLVFFNPFVSKFWFSLGASLHMSEQYSQALHAYGVTAVLRDKDPYPHYYAYICYTLTNEHEEAEKALEMAWVRAQHKPLYNELKEEILDIRKHK

SEQ ID NO: 1023 - protein, 498 aa, Chlamydia pneumoniae
  CPn1022
FSFFFYALKLQIMNMPVPSAVPSANITLKEDSSTVSTASGILKTATGEVLVSCTALEGSSSTDALISLALGQIILATQQELLLQSTNVHQLLFLPPEVVELEIQVVDLLVQLEHAETITSEPQETQTQSRSEQTLPQQSSSKQSALSPRSLKPEISDSKQQQALQTPKDSAVRKHSEAPSPETQARASLSQASSSSQRSLPPQESAPERTLLEQQKASSFSPLSQFSAEKQKEALTTSKSHELYKERDQDRQQREQHDRKHDQEEDAESKKKKKKRGLGVEAVAEEPGENLDIAALIFSDQMRPPAEETSKKETTFKKKLPSPMSVFSRFIPSKNPLSVGSSIHGPIQTPKVENVFLRFMKLMARILGQAEAEANELYMRVKQRTDDVDTLTVLISKINNEKKDIDWSENEEMKALLNRAKEIGVTIDKEKYTWTEEEKRLLKENVQMRKENMEKITQMERTDMQRHLQEISQCHQARSNVLKLLKELMDTFIYNLRP

SEQ ID NO: 1024 - protein, 108 aa, Chlamydia pneumoniae
  CPn1023
GLDFLEIFIMKKVVTLSIIFFATYCASELSAVTVVAVPLSEAPGKIQVRPVVGLQFQEEQGSVPYSFYYPYDYGYYYPETYGYTKNTGQESRECYTRFEDGTIFYECD

SEQ ID NO: 1025 - protein, 328 aa, Chlamydia pneumoniae
  CPn1024
IFFFPWFSLCSLKIAPLPILKLHSLASMTMPSTQFHTTILEQFSLFLSVDRGLCQQSIAAYRQDISSFLTISAISSPQDISQNSVYIFAEELYRRKEAETTLARRLIALKVFFLFLKDQQLLPYPPIIEHPKIWKRLPSVLTPQEVDALLAVPLQMEKNPRHLAFRDTAILHTLYSTGVRVSELCDLRLGHVSDDCIRVTGKGSKTRLVPLGSRAREAIDAYLCPFRDQYQKKNPHEDHLFLSTRGHKLERSCVWRRIHNYAKQVTSKPVSPHSLRHAFATHLLDNKADLRVIQEMLGHARIASTEVYTHVAADSLIEKFLAHHPRNL

SEQ ID NO: 1026 - protein, 538 aa, Chlamydia pneumoniae
  CPn1025
GAEQFSSYREKTMERKRFIDCDSTKILQELALNPLDLTAPGVLSAERIKKFSLLGGGFTFSFATERLDDAILAALISLAEERGLHESMLAMQQGQVVNYIEGFPSEMRPALHTATRAWVTDSSFTGEAEDIAVRSRVEAQRLKDFLTKVRSQFTTIVQIGIGGSELGPKALYRALRAYCPTDKHVHFISNIDPDNGAEVLDTIDCAKALVVVVSKSGTTIETAVNEAFFADYFAKKGLSFKDHFIAVTCEGSPMDDTGKYLEVFHLWESIGGRFSSTSMVGGVVLGFAYGFEVFLQLLQGASAMDQIALQPNARENLPMLSALISIWNRNFLGYPTEAVIPYSSGLEFFPAHLQQCCMESNGKSIAQDGRRVGFSTSPVIWGEPGTNGQHSFFQCLHQGTDIIPVEFIGFEKSQKGEDISFQGTTSSQKLFANMIAQAIALACGSENTNPNKNFDGNRPSSVLVSSQLNPYSLGELLSYYENKIVFQGLCWGINSFDQEGVSLGKALANRVLELLEGADASNFPEAASLLTLFNIKFR

SEQ ID NO: 1027 - protein, 59 aa, Chlamydia pneumoniae
  CPn1026
CSFGFGKICEDRMFFIAVRSRGFLDIHGILAARKGKQVVKSTAGAWIGSRGAVFYSLVS

SEQ ID NO: 1028 - protein, 528 aa, Chlamydia pneumoniae
  CPn1027
NMPGSVSSPPLSPVIVRERVPSSSGSDLIQPHAVLKISILIFALVTILGIVLVVLSSALGALPSLVLTVSGCIAIAVGLIGLGILVTRLILSTIRKVDAMGYDAAVKEEQYLSRIRELESENREIRDRNRAVEDQCAHLSEENKDLRDPEYLHGMTERLIASLEIENQALVAENILLKDWNASLSRDFRAYKQKFPLGALEPWKEDIACIMEQNLFLKPECIAMVKSLPLETQRLFLYPKGFQSLVNRFAPRSRFFQTPKYEYNSRNENEDGKVAAVCARLKKEFFSAVLGACSYEELGGICERAVALKETLPLPEAVYDTLVQEFPNLLTAESLWKEWCFYSYPYLRPYLSVDYCKRLFVQLFEELCLKLFTTGSPEDQALVRLFSYYRNHIPAVLASFGLPPPETGGSVFVLLPKQENLLWSQIEVLATRYLKDTFVRNSEWTGSFEMMFSYNEMCKEISEGRIRFAEDYETRHSEEFPPSPLSEEGEGEEFLPPCSEEEVSVLERPDLDVDSMWVWHPPVPKGPL

SEQ ID NO: 1029 - protein, 335 aa, Chlamydia pneumoniae
  CPn1028
FFLKGVRMAFKEVVRVAVTGGKGQIAYNFLFALAHGDVFGVDRGVDLRIYDVPGTERALSGVRMELDDGAYPLLHRLRVTTSLNDAFDGIDAAFLIGAVPRGPGMERGDLLKQNGQIFSLQGAALNTAAKRDAKIFVVGNPVNTNCWIAMKHAPRLHRKNFHAMLRLDQNRMHSMLAHRAEVPLEEVSRVVIWGNHSAKQVPDFTQARISGKPAAEVIGDRDWLENILVHSVQNRGSAVIEARGKSSAASASRALAEAARSIFCPKSDEWFSSGVCSDHNPYGIPEDLIFGFPCRMLPSGDYEIIPGLPWEPFIRNKIQISLDEIAQEKASVSSL

SEQ ID NO: 1030 - protein, 286 aa, Chlamydia pneumoniae
  CPn1029
RVFVISTMLWGVSMRQSFDELSQNAFKNIFNKQRFCFIFCSLCCFGFVFALFLKLCSRLAPEISLSTLGLGAFFCAFSVICASAIIVQFLLHKESQGETSKLCCAIKNTWSSLWLSLLVSMPFFIAMVAVVTVAMLSSFLGSLPWVGKLFHTVLIFIPYLSATALILLFLGSFSCLFFCIPVLHNQESIDYRKLLECFRGNILRQFIGVVIALVPLALCSWLALDSFYLMTHLVEIADIHTWSFLAQMFVLIVPIALILTPAVSFFFNFSFSFYLAKQEEEKALVK

SEQ ID NO: 1031 - protein, 353 aa, Chlamydia pneumoniae
  CPn1030
FKVHFMRIAVLGAGYAGLSVTWHLLLHSQGTATIDLFDPIPLGEGASGMSSGLLHAFTGKKALKPPLADQGINATHALITEASKALNVPIVISQGILRPAIDEDQAQLFTERVEEFPKEVEWWEKARCEISIPSMVIPPNLGALFIKSGVTLNNDLYIQGLADACMKLGTQFYDELIEDLADIEEFYDHIIVTPGANASILPELKDMPVNKVKGQLLEISWPKDLAMLSFSINAHKYMVANTQKNTCILGATFEHNQPEETPDPAIAYQEIMPPVLSLFPGLKDAQVLHCYAGMRSSSKSRLPVISRIREKLWFLGGLGSKGLLYHGITGDMLAQAVLRKSTAYIAKEFLFTI

SEQ ID NO: 1032 - protein, 490 aa, Chlamydia pneumoniae
  CPn1031
IKETFMTSRTKSSKNLGTIALAGMVVSSIIGGGIFSLPQNMAATAGAGAVILSWILTGFGMFFIANTFRILSTIRPDLKEGIYMYSREGFGPYIGFTIGWGYWLCQIFGNVGYAVITMDALNYFFPPYFQGGNTLPAILGGSILIWVFNFIVLKGIRQASIINVIGTIFKIIPLIIFIILTAFFFKLAVFKTDFWGHAVTKAQPSLGSVSSQLKGTMLVTLWAFIGIEGAVVMSGRAKNPLSVGQATVLGFLGCLTIYILFSLLPFGSLFQHQLANIPNPSTAGVLDILVGKWGEVLMNVGLIIAVLSSWLSWTIIVAEIPFSAAKNGTFPEIFTIENKEKSPSVSLYITSSVMQLAMLLVYFSSNAWNTMLSITGVMVLPAYLASAAFLFKLSKSKTYPKKGSIKAPLAMITGILGVVYSLWLIYAGGLKYLFMALVLLALGIPFYIDAGKKKKNAKTFFAKKEIVGMTFIGLLALTAIFLFLTGRIKI

SEQ ID NO: 1033 - protein, 196 aa, Chlamydia pneumoniae
  CPn1032
LMAYGTRYPTLAFHTGGIGESDDGMPPQPFETFCYDSALLQAKIENFNIVPYTSVLPKELFGNIVPVDTCVKSFKHGAVLEVIMAGRGAALSDGTHAIATGIGICWGKDKNGELIGGWAAEYVEFFPTWINDEIAETHAKMWLKKSLQHELDLRSIAKHSEFQFFHNYINIKQKFGFCLTALGFLNFENAEPAKVN

SEQ ID NO: 1034 - protein, 490 aa, Chlamydia pneumoniae
  CPn1033
NNKKKDYSGEFLTTDTVDSIAFLPSEENFCYIKTILFFRVKKKHYAFFYGEFMISFRFLLLSGLCALGISSYAETPKETTGHYHRYKARIQKKHPESIKESAPSETPHHNSLLSPVTNIFCSHPWKDGISVSNLLTSVEKATNTQISLDFSILPQWFYPHKALGQTQALEIPSWQFYFSPSTTWTLYDSPTAGQGIVDFSYTLIHYWQTNGVDANQAAGTASSMNDYSNRENNLAQLTFSQTFPGDFLTLAIGQYSLYAIDGTLYDNDQYSGFISYALSQNASATYSLGSTGAYLQFTPNSEIKVQLGFQDSYNIDGTNFSIYNLTKSKYNFYGYASWTPKPSCGDGQYSVLLYSTRKVPEQNSQVTGWSLNAAQHIHEKLYLFGRINGATGTALPINRSYVLGLVSENPLNRHSQDLLGIGFATNKVNAKAISNVNKLRRYESVMEAFATIGFGPYISLTPDFQLYIHPALRPERRTSQVYGLRANLSL

SEQ ID NO: 1035 - protein, 286 aa, Chlamydia pneumoniae
  CPn1034
KTSWQKYKKYLSYSILVQKIARYVMKTWLFFTFLFSCSSFYASCRYAEVRSIHEVAGDILYDEENFWLILDLDDTLLQGGEALSHSIWKSKAIQGLQKQGTPEQEAWEAVVPFWIEIQEMGTVQPIESAIFLLIEKIQKQGKTTFVYTERPKTAKDLTLKQLHMLNVSLEDTAPQPQAPLPKNLLYTSGILFSGDYHKGPGLDLFLEICTPLPAKIIYIDNQKENVLRIGDLCQKYGIAYFGITYKAQELHPPIYFDNIAQVQYNYSKKLLSNEAAALLLRHQMHE

SEQ ID NO: 1036 - protein, 504 aa, Chlamydia pneumoniae
  CPn1035
VVQLPLMVPIVHLQIWRFSMIYYGVSVMLCATVSGPSFCEAKQQILKSLHLVDIIELRLDLINELDDQELHTLITTAQNPILTFRQHKEMSTALWIQKLYSLAKLEPKWMDIDVSLPKTALQTIRKSHPKIKLILSYHTDKNEDLDAIYNEMLATPAEIYKIVLSPENSSEALNYIKKARLLPKPSTVLCMGTHGLPSRVLSPLISNAMNYAAGISAPQVAPGQPKLEELLSYNYSKLSEKSHIYGLIGDPVDRSISHLSHNFLLSKLSLNATYIKFPVTIGEVVTFFSAIRDLPFSGLSVTMPLKTAIFDHVDALDASAQLCESINTLVFRNQKILGYNTDGEGVAKLLKQKNISVNNKHIAIVGAGGAAKAIAATLAMQGANLHIFNRTLSSAAALATCCKGKAYPLGSLENFKTIDIIINCLPPEVTFPWRFPPIVMDINTKPHPSPYLERAQKHGSLIIHGYEMFIEQALLQFALWFPDFLTPESCDSFRNYVKNFMAKV

SEQ ID NO: 1037 - protein, 399 aa, Chlamydia pneumoniae
  CPn1036
GYDKPCSCRSCIIPTMLQTMMSETIITTPHVVKLISNFFQKKLFSSISTAYPLVIITDVSVQQHLLGPILDHIKMLGYQVIVLTFPPGEPNKTWETFISLQYQLVDQNISPKSSIIGIGGGTVLDMTGFLAATYCRGLPLYLIPTTITAMVDTSIGGKNGINLRGIKNRLGTFYLPKEVWMCPQFLSTLPREEWYHGIAEAIKHGFIADAYLWEFLNSHSKMLFSSSQILHEFIKRNCQIKAAIVAEDPYDRSLRKILNFGHSIAHAIETLAKGTVNHGQAVSVGMMIETRISLAEGVMKTPQLIDQLERLLKRFNLPSTLKDLQSIVPEHLHNSLYSPENIIYTLGYDKKNLSQHELKMIMIEHLGRAAPFNGTYCASPNMEILYDILWSECHVMRHC

SEQ ID NO: 1038 - protein, 388 aa, Chlamydia pneumoniae
  CPn1037
LHFSRGSRRSFLEELLRTSVSRSHYLVKVMKNSFGSLFSFTTWGESHGPSIGVVIDGCPAGLELHESDFVPAMKRRRPGNPGTSSRKENDIVQILSGVYKGKTTGTPLSLQILNTDVDSSPYENSERLYRPGHSQYTYEKKFGIVDPNGGGRSSARETACRVAAGVVAEKFLANQNIFTLAYLSSLGSLTLPHYLKISPELIHKIHTSPFYSPLPNEKIQEILTSLHDDSDSLGGVISFITSPIHDFLGEPLFGKVHALLASALMSIPAAKGFEIGKGFASAQMRGSQYTDPFVMEGENITLKSNNCGGTLGGITIGVPIEGRIAFKPTSSIKRPCATVTKTKKETTYRTPQTGRHDPCVAIRAVPVVEAMINLVLADLVLYQRCSKL

SEQ ID NO: 1039 - protein, 184 aa, Chlamydia pneumoniae
  CPn1038
WKLELRNVMTIILCGLPTSGKSSLGKALAKFLNLPFYDLDDLIVSNYSSALYSSSAEIYKAYGDQKFSECEARILETLPPEDALISLGGGTLMYEASYRAIQTRGALVFLSVELPLIYERLEKRGLPERLKEAMKTKPLSEILTERIDRMKEIADYIFPVDHVDHSSKSSLEQASQDLITLLKS

SEQ ID NO: 1040 - protein, 449 aa, Chlamydia pneumoniae
  CPn1039
VCFTMLTYKVSPSSVYGNAFIPSSKSHTLRAILWASVAEGKSIIYNYLDSPDTEAMICACKQMGASIKKFPQILEIVGNPLAIFPKYTLIDAGNSGIVLRFMTALACVFSKEITVTGSSQLQRRPMAPLLQALRNFGASFHFSSDKSVLPFTMSGPLRSAYSDVEGSDSQFASALAVACSLAEGPCSFTIIEPKERPWFDLSLWWLEKLHLPYSCSDTTYSFPGSSHPQGFSYHVTGDFSSAAFIAAAALLSKSLQPIRLRNLDILDIQGDKIFFSLMQNLGASIQYDNEEILVFPSSFSGGSIDMDGCIDALPILTVLCCFADSPSHLYNARSAKDKESDRILAITEELQKMGACIQPTHDGLLVNPSPLYGAVLDSHDDHRIAMALTIAALYASGDSRIHNTACVRKTFPNFVQTLNIMEARIEECHDNYSMWSTHKRKVFARESFG

SEQ ID NO: 1041 - protein, 268 aa, Chlamydia pneumoniae
  CPn1040
RPSQSLFLRTWSPSSSFREHTVCAAPLLYPRRRSPDYLFSPTGCPMSTTTVKHFIHTASRWEPVLKEIVASNYWHAQWINTLSFLENSGAKKISASEHPTEVKEEVLKHAAEEFRHGHYLKTQISRISETSLPDYTSKNLLGGLLTKYYLHLLDLRTCRVLENEYSLSGQTLKTAAYILVTYAIELRASELYPLYHDILKEAQSKITVKSIILEEQGHLQEMERELKDLPHGEELLGYACQFEGELCLQFVERLEQMIFDPSSTFTKF

SEQ ID NO: 1042 - protein, 526 aa, Chlamydia pneumoniae
  CPn1041
DFRRIFIPLHIKKTSGRCVFFLVMFLDFSEPSISRKYQSHLFNGRSNALTKPQYLRYGGKWVSRGRRALANSRNQASYNRDSCQGKRNHKDNHKLLCRTMEGSMDKQSSGNSGCIWHPFTQSALDSTPIKIVRGEGAYLYAESGTRYLDAISSWWCNLHGHGHPYITKKLCEQAQKLEHVIFANFTHEPALELVSKLAPLLPEGLERFFFSDNGSTSIEIAMKIAVQYYYNQNKAKSHFVGLSNAYHGDTFGAMSIAGTSPTTVPFHDLFLPSSTIAAPYYGKEELAIAQAKTVFSESNIAAFIYEPLLQGAGGMLMYNPEGLKEILKLAKHYGVLCIADEILTGFGRTGPLFASEFTDIPPDIICLSKGLTGGYLPLALTVTTKEIHDAFVSQDRMKALLHGHTFTGNPLGCSAALASLDLTLSPECLQQRQMIERCHQEFQEAHGSLWQRCEVLGTVLALDYPAEATGYFSQYRDHLNRFFLERGVLLRPLGNTLYVLPPYCIQEEDLRIIYSHLQDALCLQPQ

SEQ ID NO: 1043 - protein, 232 aa, Chlamydia pneumoniae
  CPn1042
NRSPFTYFRANFFMQRIIIVGIDTGVGKTIVSAILARALNAEYWKPIQAGNLENSDSNIVHELSGAYCHPEAYRLHKPLSPHKAAQIDNVSIEESHICAPKTTSNLIIETSGGFLSPCTSKRLQGDVFSSWSCSWILVSQAYLGSINHTCLTVEAMRSRNLNILGMVVNGYPEDEEHWLTQEIKLPIIGTLAKEKEITKTIISCYAEQWKEVWTSNHQGIQGVSGTPSLNLH

SEQ ID NO: 1044 - protein, 383 aa, Chlamydia pneumoniae
  CPn1043
PMLCQQFLIEALARRKSKHTYRSLSLNSHLIDFTSNDYLGFASSPELRKEYITKLHAIESLGATGSRLLTGHSQLCQRIEEQLAAYHNFESCLIFNTGYTANLGLLYALATDQDRILHDLYIHASIYDGIRLSKAQSFPFNHNDLNHLEKRLASSHLGRTFVCVESVYSLHGSVAPLQAISELCERYSAYLIVDEAHAVGVFGDQGEGLVSALGLQDKVLATVYTFGKALGTHGAAIAGSSILKDYLINFCRPFIYTTAQPPHALTAIELAYEHNQRAFNQREHLSALIHHFREKAQNLGLQLMKDNTTTPIQSICVSGSHRARQAALQIQNSGYDVRPIVSPTVKQREELLRICLHAFNTKNEIDHLLHTLEQIFLCNVSSL

SEQ ID NO: 1045 - protein, 334 aa, Chlamydia pneumoniae
  CPn1044
AKHMREETVSWSLEDIREIYHTPVFELIHKANAILRSNFLHSELQTCYLISIKTGGCVEDCAYCAQSSRYHTHVTPEPMMKIVDVVERAKRAVELGATRVCLGAAWRNAKDDRYFDRVLAMVKSITDLGAEVCCALGMLSEEQAKKLYDAGLYAYNHNLDSSPEFYETIITTRSYEDRLNTLDVVNKSGISTCCGGIVGMGESEEDRIKLLHVLATRDHIPESVPVNLLWPIDGTPLQDQPPISFWEVLRTIATARVVFPRSMVRLAAGRAFLTVEQQTLCFLAGANSIFYGDKLLTVENNDIDEDAEMIKLLGLIPRPSFGIERGNPCYANNS

SEQ ID NO: 1046 - protein, 234 aa, Chlamydia pneumoniae
  CPn1045
GTLPMNTSHRKTLVFSYLSSTFTLLLVLSNLVLSSKLIPTTFFNFIIPGGLILYPLTFLISDVVNEIFGPKKARVMIFSAFIANLLASSIVQIFMFFPVASPEMQTAWHCLFDLSPLRFLASLLAFIVSQQLDIVLYTFFKNRTPNSSLWLRSNGSTWISQIPDTFIVDTCILYFGMGLSFPQTLNIMFYSYIYKITFCVLTTPLFYLAVNTIRKFLGMPSTKIANTVPLINQP

SEQ ID NO: 1047 - protein, 362 aa, Chlamydia pneumoniae
  CPn1046
VHYCERTLDPKYILKIALKLRQSLSLFFQNSQSLQRAYSTPYSYYRIILQKENKEKQALARHKCISILEFFKNLLFVHLLSLSKNQREGCSTDMAVVSTPFFNRNLWYRLLSSRFSLWKSYCPRFFLDYLEAFGLLSDFLDHQAVIKFFELETHFSYYPVSGFVAPHQYLSLLQDRYFPIASVMRTLDKDNFSLTPDLIHDLLGHVPWLLHPSFSEFFINMGRLFTKVIEKVQALPSKKQRIQTLQSNLIAIVRCFWFTVESGLIENHEGRKAYGAVLISSPQELGHAFIDNVRVLPLELDQIIRLPFNTSTPQETLFSIRHFDELVELTSKLEWMLDQGLLESIPLYNQEKYLSGFEVLCQ

SEQ ID NO: 1048 - protein, 269 aa, Chlamydia pneumoniae
  CPn1047
FGSRNMGSSMHVGVIGCSGRTGKVIVSALEQSSEYTLGPGFSRSSALTLFQVIAHNDVLVDFSHPLLTKEVVAHLLISPKPLIIGTTGFPGKCKEAHDSLEELTHIVPVVVCPNASLGAYIHKRLVMLLSQLCNPQFDIRIRETHHRYKKDSLSGTAQDLLDTIQQVKQEDWGEEYEVGQRDSSKKTIEVQSSRVGDIPGEHEVAFISSGEQILVRHTVFSRNVFGRGILSILDWLKTLNPQPGLYSLGDTLELVLRNEHCLLKKTTDH

SEQ ID NO: 1049 - protein, 339 aa, Chlamydia pneumoniae
  CPn1048
DGERKGMRIAVLGVTGLVGQKFVALLHKWYRDWVIAEVVASNSKYGQSYGDACIWQEPIGPMPEMVRDLPIRKIEEVQSDIVVSFLPSSAESMEAYCLSQGKVVFSNASTYRMHSSVPIIIPEVNSDHFQLLEEQPYPGKIITSPNCCVSGITLALAPLRKFSLDHVHIVTLQSASGAGYPGVPSLDLLANTVPHIVGEEEKILRETVKILGSSKQPLPCKLSVTVHRVPVAYGHTLSLHVTFSKDVDLDEILYSYQEKNKEFPNTYQLYDNPWSPQARKHLSHDDMRVHLGPITYGGDFRTIKMNVLIHNLVRGAAGTLLASMENYFFDYLKREMCLR

SEQ ID NO: 1050 - protein, 443 aa, Chlamydia pneumoniae
  CPn1049
EGNVSKIVYKFGGTSLATAENICLVCDIICKDKPSFVVVSAIAGVTDLLVDFCSSSLREREEVLRKIEGKHEEIVKNLAIPFPVSTWTSRLLPYLQHLEISDLDFARILSLGEDISASLVRAVCSTRGWDLGFLEARSVILTDDSYRRASPNLDLMKAHWHQLELNQPSYIIQGFIGSNGLGETVLLGRGGSDYSATLIAELARATEVRIYTDVNGIYTMDPKVISDAQRIPELSFEEMQNLASFGAKVLYPPMLFPCMRAGIPIFVTSTFDPEKGGTWVYAVDKSVSYEPRIKALSLSQYQSFCSVDYTVLGCGGLEEILGILESHGIDPELMIAQNNVVGFVMDDDIISQEAQEHLVDVLSLSSVTRLHHSVALITMIGDNLSSPKVVSTITEKLRGFQGPVFCFCQSSMALSFVVASELAEGIIEELHNDYVKQKAIVAT

SEQ ID NO: 1051 - protein, 305 aa, Chlamydia pneumoniae
  CPn1050
LCKTKSYSRHVGRIMHLLTATVTPFFPNGTIDFASLERLLSFQDAVGNGVVLLGSTGEGLSLTKKEKQALICFACDLQLKVPLFVGTSGTLLEEVLDWIHFCNDLPISGFLMTTPIYTKPKLCGQILWFEAVLNAAKHPAILYNIPSRAATPLYLDTVKALAHHPQFLGIKDSGGSVEEFQSYKSIAPHIQLYCGDDVFWSEMAACGAHGLISVLSNAWPEEAREYVLNPQEQDYRSLWMETCRWVYTTTNPIGIKAILAYKKAITHAQLRLPLSIEDFDLENVSPAVESMLAWPKLRTSVFSYS

SEQ ID NO: 1052 - protein, 105 aa, Chlamydia pneumoniae
  CPn1051
FFMTPKSIQQLHLIKTIDPVRKISPVTTKKSSFFRQSLLRFLELFWMFLYCIRSIRFHCVHIATFICRGLILFLTTLFLSMICILHFITLPWICKEDPRIIRKNK

SEQ ID NO: 1053 - protein, 256 aa, Chlamydia pneumoniae
  CPn1052
FFIQKMKYNSREKIKSALRICSSYCITVFRNNFSLSCYDKIFYSLSCYVFNGPNSIGRCRSFCFFRGKKTEVETKEVKIKDEIRPSLEGNDPVKVAESFPKRRAALESLSSQSSIGNLCAISNFLDSQMLSRNFSKEIWGSTIFTRSKSTCDAEGSEPFRYTACGYLAGLRSKLAGSYELGVTAGLLQGRLKDVSDSHRTRATSSILSVHGSMVTRPLSCTKYIVGKARPLLFFFRLTSDVRRDLKKKFRLEFCKD

SEQ ID NO: 1054 - protein, 188 aa, Chlamydia pneumoniae
  CPn1053
KKSSDLNFAKIDHNHLYLTCLGDLGVACPILSTDCLPNYSEKASHEVLVYSKFRCISGEPSRLATSGNDTYYSIVSLPIGLRYEVTSPSGRHDFNIDMHVAPKIGAVLSHGTREAKEIPGSSKDYAFFSLTARESLMISEKLAMTFQVSEVIQNCYSQCTKVTKTNLKEQYRHLSHNTGFELSVKSAF

SEQ ID NO: 1055 - protein, 819 aa, Chlamydia pneumoniae
  CPn1054
SRWHHRFIMQVLLSPQLPPPPQHSVGSISSPSKLRVLAITFLVFGMLLLISGALFLTLGIPGLSAAISFGLGIGLSALGGVLMISGLLCLLVKREIPTVRPEEIPEGVSLAPSEEPALQAAQKTLAQLPKELDQLDTDIQEVFACLRKLKDSKYESRSFLNDAKKELRVFDFVVEDTLSEIFELRQIVAQEGWDLNFLINGGRSLMMTAESESLDLFHVSKRLGYLPSGDVRGEGLKKSAKEIVARLMSLHCEIHKVAVAFDRNSYAMAEKAFAKALGALEESVYRSLTQSYRDKFLESERAKIPWNGHITWLRDDAKSGCAEKKLRDAEERWKKFRKAVFWVEEDGGFDINNLLGDWGTVLDPYRQERMDEITFHELYEKTTFLKRLHRKCALAKTTFEKKRSKKNLQAVEEANARRLKYVRDWYDQEFQKAGERLEKLHALYPEVSVSIRENKIQETRSNLEKAYEAIEENYRCCVREQEDYWKEEEKREAEFRERGNKILSPEELESSLEQFDHGLKNFSEKLMELEGHILKLQKEATAEVENKILSDAESRLEIVFEDVKEMPCRIEEIEKTLRMAELPLLPTKKAFEKACSQYNSCAEMLEKVKPYCKESLAYVTSKERLVSLDEDLRRAYTECQKRFQGDSGLESEVRACREQLRERIQEFETQGLDLVEKELLCVSSRLRNTECDCVSGVKKEAPPGKKFYAQYYDEIYRVRVQSRWMTMSERLREGVQACNKMLKAGLSEEDKVLKEEEYWLYREERKNKEKRLVGTKIVATQQRVAAFESIEVPEIPEAPEEKPSLLDKARSLFTREDHT

SEQ ID NO: 1056 - protein, 313 aa, Chlamydia pneumoniae
  CPn1055
CKYLYHHSYPPPPDHSVGAFFCLSKFRVLAITFLVLGVLFLISGALFLTLGISGLSAAISFGLGIGLSALGGVLVVSGLLCLLAKREVPTVRPEEIPEGVSVAPSEEPALQATQKTLAQLPKELDQLDRYIQEVVSCLGKLKDLRCEDQGLLKDAKEKLQVFDFVWKDMMTEFVELQQIMDQEGWYLKCLIQEMRDIGSTLFMSQVSLFKLWEWLGYLPSGDVRGERLKKSAREVVDRFMRRICDTRKVAMTFDRNAYGVAKTAFEKAFGALETCVYKSMTESYREAFCEYKKTKILRDEEKILRICYLELRR

SEQ ID NO: 1057 - protein, 249 aa, Chlamydia pneumoniae
  CPn1056
GEDIKDMLSRVEEIEMMLRVIELPLLPIKQALEKAFVQYNSYKAKLTKVEPCFRESPAYITSEERLQSLDQTLERAYKEYQKRFQEPSRLESEVSGCREHLREQVKQFETQGLDLIKEELIFVSDVLFRKMVSCLVSTVHVPFMEFYYEYFELHRLRLRAQWMANAEIYSKVRKAFPEMLKETLEKAKAPREEEYWLLCEERKSKEKRLILNKIEAAQQRVKDLEPPPIKETGKQKRKKEYSFFIRLKS

SEQ ID NO: 1058 - protein, 710 aa, Chlamydia pneumoniae
  CPn1057
IIHFYFFNFAMPEPLYTNKLITEKSPYLLLYAHTPVNWYPWGAEAFHIAAIENKPVFLSIGCKHSRWCQVMLQESYTNPEIAAMLNEYFVNVKVDKEELPYVAKLYGDLAQMLAVSGDHQETVSWPLNVFLTPDLVPFFSVNYLGNEGKLGLPSFPQIIDKLHFMWEDAEEREALVEQAMKVLEIASFLEGCVRKEILDESSLKRTVAALYQDIDPHYGGVKAFPKRLPGLLLQFFLRYSLEYQESRGLFFVDRSLSMVALGGVRDHIGGGVYSYTIDDKWLIPAFEKRLIDNALMALNYLEAWACLGKEEYRGIGKQILSYILSELYSPEVGAFYSSEQAENWGAGGQNFYTWSVEEISNALGEDAEIFCDYYGISREGFFNGRNILHIPVHREIEELSEKYHRSIEAIEDIVDRSRDILKGIRAQRSHRSKDDLSLTFNNGWMIYTFAYAGRLLGEVEYIEIGKKCGEFVRNSLYKHHELYRRWREGEAKYRASLEDYGALILGVLALYESGCGSFWLSFAEELMQEVVLSFRSEEGGFYSVDGRDSTLLIKQSPLSDGETISGNALICQCLLSLHLITEKKHYLTYAEDILQIAQACAHTHKFSSLGLLIASQNYFSRKHVKVLIALGDQEDRSPVLKCLSGLFLPYLSLIWMTQENQEHLETVLPEYEHCLIPKGDCTATTIYVLEVDQCKRFKDLELFRRYLISL

SEQ ID NO: 1059 - protein, 365 aa, Chlamydia pneumoniae
  CPn1058
EVMKLYQTLRGIVLVSTGCIFLGMHGGYAAEVPVTSSGYENLLESKEQDPSGLAIHDRILFKVDEENVVTALDVIHKLNLLFYNSYPHLIDSFPARSQYYTAMWPVVLESVIDEFLMVADAKAKRIATDPTAVNQEIEEMFGRDLSPLYAHFEMSPNDIFNVIDRTLTAQRVMGMMVRSKVMLKVTPGKIREYYRKLEEEASRKVIWKYRVLTIKANTESLASQIADKVRARLNEAKTWDKDRLTALVISQGGQLVCSEEFSRENSELSQSHKQELDLIGYPKELCGLPKAHKSGYKLYMLLDKTSGSIEPLDVMESKIKQHLFALEAESVEKQYKDRLRKRYGYDASMIAKLLSEEAPPLFSLL

SEQ ID NO: 1060 - protein, 277 aa, Chlamydia pneumoniae
  CPn1059
VTRSSPAQLSRFLSEIQNKPKKSLSQNFLVDQNIVKKIVATSEVIPQDWVLEIGPGFGALTEELIAAGAQVIAIEKDPMFAPSLEELPIRLEIIDACKYPLDQLQEYKTLGKGRVVANLPYHITTPLLTKLFLEAPDFWKTVTVMVQDEVARRIVAQPGGRDYGSLTIFLQFFADIHYAFKVSASCFYPKPQVQSAVIHMKVKETLPLSDEEIPVFFTLTRTAFQQRRKVLANTLKGLYPKEQVEQALKELGLLLNVRPEVLSLNDYLALFHKMQAG

SEQ ID NO: 1061 - protein, 656 aa, Chlamydia pneumoniae
  CPn1060
YKRFLYIHITKVMTSSSCPLLDLILSPADLKKLSISQLPGLAEEIRYRIISVLSQTGGHLSSNLGIVELTIALHYVFSSPKDKFIFDVGHQTYPHKLLTGRNNEGFDHIRNDNGLSGFTNPTESDHDLFFSGHAGTALSLALGMAQTTPLESRTHVIPILGDAAFSCGLTLEALNNISTDLSKFVVILNDNNMSISKNVGAMSRIFSRWLHHPATNKLTKQVEKWLAKIPRYGDSLAKHSRRLSQCVKNLFCPTPLFEQFGLAYVGPIDGHNVKKLIPILQSVRNLPFPILVHVCTTKGKGLDQAQNNPAKYHGVRANFNKRESAKHLPAIKPKPSFPDIFGQTLCELGEVSSRLHVVTPAMSIGSRLEGFKQKFPERFFDVGIAEGHAVTFSAGIAKAGNPVICSIYSTFLHRALDNVFHDVCMQDLPVIFAIDRAGLAYGDGRSHHGIYDMSFLRAMPQMIICQPRSQVVFQQLLYSSLHWSSPSAIRYPNIPAPHGDPLTGDPNFLRSPGNAETLSQGEDVLIIALGTLCFTALSIKHQLLAYGISATVVDPIFIKPFDNDLFSLLLMSHSKVITIEEHSIRGGLASEFNNFVATFNFKVDILNFAIPDTFLSHGSKEALTKSIGLDESSMTNRILTHFNFRSKKQTVGDVRV

SEQ ID NO: 1062 - protein, 89 aa, Chlamydia pneumoniae
  CPn1061
FGSLMVEIHHKDPSLKKLFALQQSLETLNSLSDIVATYEAMFSLIYEGLNKALRKDQLCYLLSVNSKGELLKSPSGDPIVQTFPIHPHH

SEQ ID NO: 1063 - protein, 559 aa, Chlamydia pneumoniae
  CPn1062
RGFPVMSSPPQAVASLTERIKTLLESNFCQIIVKGELSNVSLQPSGHLYFGIKDSQAFLNGAFFHFKSKYYDRKPKDGDAVIIHGKLAVYAPRGQYQIVAHALVYAGEGDLLQKFEETKRRLTAEGYFATEKKKPLPFAPQCIGVITSPTGAVIQDILRVLSRRARNYKILVYPVTVQGNSAAHEISKAIEVMNAENLADVLIIARGGGSIEDLWAFNEEILVKAIHASTIPIVSAVGHETDYTLCDFASDVRAPTPSAAAEIVCKSSEEQVQVFEGYLRHLLSHSRQLLTSKKQQLLPWRRFLDRAEFYTTAQQQLDSIEIAIQKGVQGKIHESKQRYDNISRWLQGDLVSRMTCRLQSLKKMLSQALSHKALSLQVRCHQLKKSLTYPRQIQQASQKLSPWRQQLDTLISRRLHYQKEEYFHKHTRLKHAHNVLEQQLRSHVQKLELLGRRLSRGCELNLQNQKIAYANVKETLATILERRYENSVARYSALKEQLHSLNPKNVLKRGYAMLFDFNENSAMISVDSLQENARVRIQLQDGEAILTVTNIEICKLIKG

SEQ ID NO: 1064 - protein, 271 aa, Chlamydia pneumoniae
  CPn1063
FCRESMRIKFRENKERKMTRQSYVLGNWKMHKTIQEAKEYVQTLASLLQGEPLSCTIGIASPFTSLRAIHEVINTTGAFLWLGAQNVHPELSGAFTGEISLPMLKEVGVEFVLVGHSERRHIFGESDAFIASKVKSVAQAGLVPVLCVGESLEVREEGKAHQVIKKQLLLGLEQMDNGSEFLIAYEPVWAIGTGKVAEASDVQDIHMFCREVVAERFSEATAEEISILYGGSVKVDNAQRFGQCSDVDGLLVGGASLEGQSFFEVAKNFNV

SEQ ID NO: 1065 - protein, 60 aa, Chlamydia pneumoniae
  CPn1064
FVRVMRFFCLFFLGFLGSFHCVAEDKGVDLFGVWDDNQITECDDSYMTEGREEVEKVVDA

SEQ ID NO: 1066 - protein, 71 aa, Chlamydia pneumoniae
  CPn1065
RHRLGRHRRTSDPCFLFYFSIPEESLPPDSCRLNQMPKHEHLPSILLKKPIIDYLKITSIYEKAIFNTGLP

SEQ ID NO: 1067 - protein, 119 aa, Chlamydia pneumoniae
  CPn1066
SMSLNKEIGMTVLFYAFLFIFLFLCVILCGLILVQESKSMGLGSSFGVDSGDSVFGVSTPDILKKVTSWCAVAFCIGCLLLSFSTNLLGKKLDAKEFLLPAAEESDTQASSESVEADES

SEQ ID NO: 1068 - protein, 206 aa, Chlamydia pneumoniae
  CPn1067
IQVLVVRDFFTELCQAHVQTMIRRLEYYGSPILRKKSSPIAEITDEIRNLVSDMCDTMEAHRGVGLAAPQVGKNVSLFVMCVDRETEDGELIFSESPRVFINPVLSDPSETPIIGKEGCLSIPGLRGEVFRPQKITVTAMDLNGKIFTEHLEGFTARIIMHETDHLNGVLYIDLMEEPKDPKKFKASLEKIKRRYNTHLSKEELVS

SEQ ID NO: 1069 - protein, 301 aa, Chlamydia pneumoniae
  CPn1068
MSCMPPPFVVTLTTSAQNNLRDQLKEKNFIFSQPQNTVFQARSNTVTCTLYPSGKLVIQGKGSEEFIEFFLEPEILHTFTHARVEQDLRPRLGVDESGKGDFFGPLCIAAVYASNAEILKKLYENKVQDSKNLKDTKIASLARIIRSLCVCDVIILYPEKYNELYGKFQNLNTLLAWAHATVINNLAPKPAGDVFAISDQFAASEYTLLKALQKKETDITLIQKPRAEQDVVVAAASILARDAFVQSIQKLEEQYQVQLPKGAGFNVKAAGREIAKQRGKELLAKISKTHFKTFDEICSGK

SEQ ID NO: 1070 - protein, 145 aa, Chlamydia pneumoniae
  CPn1069
VIMQEHIHKELLHLGEIFRSSRESQSLSLKDVEAATSIRYSCLEAIEQGCLGKLISPVYAQGFIKKYATYLGLDGDSILQEHPYVMKIFKEFSDHNMEMLLDLESMGGRNSPERAIHSWSNLWWAGLIIIGGIMVWWLGSLFSIF

SEQ ID NO: 1071 - protein, 460 aa, Chlamydia pneumoniae
  CPn1070
RRSLMTFPCGNCNCYYRETPPPNPGGEDIPLQEGGQSGSQGGRVITQQPGTGGREMGISLGSDNVLGMVEQAGSLLNNLLDSARMQRLGHYCYRTGTPWCREHCPGFLQWIWGGCCACCLETVDDPDNPSAQFLQQLIQQYGPICVGMSFQQLPHCTQKIEQGEPLGDGDKQEVENGCKLHRELLKAAQPRCMGESLVKLLQNNGLGEDMQQTPPWSLILQAVSEGALSFVTSSDNPPTCWILQPEQQPCPPPPTDEEQLQGAVGGAPAPQQKKHPAQECRVTCKLNFRTLLQKLSRLEVLSLESGYKGPLGQAAKQIVDLIKKSLKRLVASDLATFLGPGIGLSLESQVFEVLVLLCLLSKGYLPLDPLHPEQTVLDPRVQGPWQRILRKVLVTTTAGENIWRQTQGEAPRQAPPPPDPWDDDEIERDGIVTGGGFGIPCQCLRCWRKLPTEKRPNRWL

SEQ ID NO: 1072 - protein, 484 aa, Chlamydia pneumoniae
  CPn1071
KGTTMVCPNNSWFRMCGNFNCEWVEVTTTEETTRQSASDISEEAGSSGGAAPITTQPTKITKVEKRVQFNTAQGDESTIHMIQEAGELVDSILSHRRTQGCTEYCYDSYATGCGQRCGSFGRLICGTYKACCLDREDNQVAGLVHECEQTHGPIAVALAAKTMGLNLMELVEKNTILSEEQKNEFRQHCSEAKTQLYGTMQSLSQNFFLEGVNSIRERGLDDSLVQAVLSFIATRSWEKTIESEEASGTSSASNSTRIPACYILNTSPLTTSRLSCGSRDARRPSSVGAEPQYVAKKYNDNGMARQLGKIQVTNLKTGDFSALGPFGLLIVKMLNSFLLSASQSTSSILKHTGGEICYTCPNFRDIVVLLMLAIGYCPANTDETSVVDIHMIDDPIMTIFYRLQYSYRTGKTSASFLKKKPSLVRQESLDCPTPAESVPLMSSLEEEDENEDDDEDGNLAYQQRILECSGHLQTLFLGIKINKE

SEQ ID NO: 1073 - protein, 304 aa, Chlamydia pneumoniae
  CPn1072
KKDYILHANWCCWKQMLKIQKKRMCVSVVITVGAIVGFFNSADAAPKKKKIPIQILYSFTKVSSYLKNEDASTIFCVDVDRGLLQHRYLGSPGWQETRRRQLFKSLENQSYGNERLGEETLAIDIFRNKECLESEIPEQMEAILANSSALVLGISSFGITGIPATLHSLLRQNLSFQKRSIASESFLLKIDSAPSDASVFYKGVLFRGETAIVDALSQLFAQLDLSPKKIIFLGEDPEVVQAVGSACIGWGMNFLGLVYYPAQESLFSYVHPYSTATELQEAQGLQVISDEVAQLTLNALPKMN

SEQ ID NO: 1074 - protein, 273 aa, Chlamydia pneumoniae
  CPn1073
MRRYLFMVLALCLYRAAPLEAVVIKITDAQAVLKFAREKTLVCFNIEDTVVFPKQMVGQSAWLYNRELDLKTTLSEEQAREQAFLEWMGISFLVDYELVSANLRNVLTGLSLKRSWVLGISQRPVHLIKNTLRILRSFNIDFTSCPAICEDGWLSHPTKDTTFDQAMAIEKNILFVGSLKNGQPMDAALEVLLSGISSPPSQIIYVDQDAERLRSIGAFCKKANIYFIGMLYTPAKQRVESYNPKLTAIQWSQIRKNLSDEYYESLLSYVKSK

What is claimed is:

1. An isolated *Chlamydia pneumoniae* protein comprising the amino acid sequence set forth in SEQ ID NO: 1047.
2. A composition comprising the isolated protein of claim 1, and a carrier.
3. The composition of claim 2, wherein the carrier is an aqueous carrier.
4. The composition of claim 2, further comprising an adjuvant.

5. The isolated *Chlamydia pneumoniae* protein of claim 1, which is bound to a solid surface.

6. The isolated *Chlamydia pneumoniae* protein of claim 5, wherein the solid surface is nitrocellulose.

* * * * *